United States Patent
Zhou et al.

(10) Patent No.: US 8,324,454 B2
(45) Date of Patent: Dec. 4, 2012

(54) NUCLEOTIDE SEQUENCES AND CORRESPONDING POLYPEPTIDES CONFERRING MODULATED GROWTH RATE AND BIOMASS IN PLANTS GROWN IN SALINE CONDITIONS

(75) Inventors: Fasong Zhou, Oxnard, CA (US); Kenneth A. Feldmann, Newbury Park, CA (US); Julissa Sosa, Northridge, CA (US)

(73) Assignee: Ceres, Inc., Thousand Oaks, CA (US)

(*) Notice: Subject to any disclaimer, the term of this patent is extended or adjusted under 35 U.S.C. 154(b) by 485 days.

(21) Appl. No.: 12/282,342

(22) PCT Filed: Mar. 14, 2007

(86) PCT No.: PCT/US2007/006544
§ 371 (c)(1),
(2), (4) Date: Nov. 17, 2008

(87) PCT Pub. No.: WO2007/139608
PCT Pub. Date: Dec. 6, 2007

(65) Prior Publication Data
US 2009/0100539 A1    Apr. 16, 2009

Related U.S. Application Data

(60) Provisional application No. 60/782,735, filed on Mar. 14, 2006.

(51) Int. Cl.
*C12N 15/00* (2006.01)
*C12N 15/82* (2006.01)

(52) U.S. Cl. .................. 800/278; 435/468; 800/287

(58) Field of Classification Search ............... None
See application file for complete search history.

(56) References Cited

U.S. PATENT DOCUMENTS
6,281,411 B1    8/2001    Adams et al.
2009/0324797 A1 * 12/2009 Bobzin et al. ............ 426/615

FOREIGN PATENT DOCUMENTS
EP          1033405 A2 *  9/2000
WO     WO 99/61616    * 12/1999
WO     WO 99/61616 A2   12/1999
WO   WO 2004/092326 A2  10/2004
WO   WO 2004/092326 A3  10/2004

OTHER PUBLICATIONS

Wells, Biochemistry 29:8509-8517.*
Ngo et al., (The Protein Folding Problem and Tertiary Structure Prediction, K. Merz., and S. Le Grand (eds.) pp. 492-495,1994).*
Guo et al. (PNAS, 101: 9205-9210, 2004).*
Keskin et al. (Protein Science, 13:1043-1055, 2004).*
Thornton et al. (Nature structural Biology, structural genomics supplement, Nov. 2000).*
Maniatis et al. (Molecular Cloning: A Laboratory Manual, Cold Spring Harbor Laboratory, 1982; see in particular pp. 387-389).*
Bustos et al., Plant Cell, 1(9):839-853, 1989.*
Yamamoto et al., Plant Cell Physiol., 35:773-778, 1995.*
NCBI GenBank Accession No. NP_179785 (Aug. 21, 2001).
NCBI GenBank Accession No. NP_565906 (Jan. 29, 2002).
NCBI GenBank Accession No. NP_565305 (Jan. 29, 2002).
NCBI GenBank Accession No. NP_567957 (Jan. 30, 2002).
NCBI GenBank Accession No. NP_566785 (Jan. 29, 2002).
NCBI GenBank Accession No. NP_567754 (Jan. 29, 2002).
NCBI GenBank Accession No. NM_129505 (Aug. 21, 2001).
NCBI GenBank Accession No. NM_119581 (Jan. 30, 2002).
NCBI GenBank Accession No. BT018295 (Oct. 27, 2004).
NCBI GenBank Accession No. NM_127763 (Nov. 4, 2005).
NCBI GenBank Accession No. BT003928 (Feb. 14, 2003).
NCBI GenBank Accession No. AY086786 (Jan. 27, 2006).
NCBI GenBank Accession No. AY092961 (Apr. 21, 2002).
NCBI GenBank Accession No. AF410323 (Aug. 27, 2001).

* cited by examiner

*Primary Examiner* — Vinod Kumar
(74) *Attorney, Agent, or Firm* — Birch, Stewart, Kolasch & Birch, LLP

(57) ABSTRACT

The present invention relates to isolated nucleic acid molecules and their corresponding encoded polypeptides able confer the trait of improved plant size, vegetative growth, growth rate, seedling vigor and/or biomass in plants challenged with saline conditions. The present invention further relates to the use of these nucleic acid molecules and polypeptides in making transgenic plants, plant cells, plant materials or seeds of a plant having plant size, vegetative growth, growth rate, seedling vigor and/or biomass that are improved in saline conditions with respect to wild-type plants grown under similar conditions.

6 Claims, 16 Drawing Sheets

Figure 1

| | | | | | |
|---|---|---|---|---|---|
|SEQ-ID-NO-90-CLONE-554272|----------|----------|----------|----------|----------|
|SEQ-ID-NO-92-CLONE-881632|----------MNCYWWHAL|----------MSGCVLGLC|VGI GGCVCVV|----------|29|
|SEQ-ID-NO-93-GI:50944095|----------MAPP|LLLLLLVPLV|AAT APCAHPIA|HPSQ----PAS|CAAEPV-APE|41|
|SEQ-ID-NO-80-CLONE-8686|----------MAHLAPLF|LLLLLPLH|AAATPSAHPIA|YPNE--PPS|CAA-AVPVPE|45|
|SEQ-ID-NO-84-CLONE-954851|----------MTRSVSFPL|FLFAVVLSLS|SSLLA|----------|----------|30|
|SEQ-ID-NO-85-CLONE-1064137|----------MTSS|----------|----------|----------|----------|10|
|SEQ-ID-NO-95-ANNOT-1494052|----------MAVPPLLLL|TLLSLPSLL|HAAI SDAYPT|I PGT--API D|GGFSDELKPI|47|
| |MSTTKTMI PL|LLLLSPLS|TASTAAYPT|I PGTI DTSVS|SSQPDNLF PI|50|

| | | | | | |
|---|---|---|---|---|---|
|SEQ-ID-NO-90-CLONE-554272|----------ENENCRI|I DI SHRYHPD|MPAWESKDSL|GQ----FLWLTRS|MANGSLANFS|76|
|SEQ-ID-NO-92-CLONE-881632|RREAHGGGRI|LDI THYYRED|MPSWESGAGV|GQ----FLWLPAS|MRNGSLANNS|90|
|SEQ-ID-NO-93-GI:50944095|RREAHGGGRI|LDI THYYRED|MPSWESDGGV|GQ----FLWLPAS|MRNGSRANNS|94|
|SEQ-ID-NO-80-CLONE-8686|RREVYEGGKI|YDI SHRYTPE|I PAWESSEGL|GKIT-FLRLAAS|MKNGSFANNS|80|
|SEQ-ID-NO-84-CLONE-954851|ROEVYGERKI|FDI THRYTQD|MPVWESTEGV|KP--FLRLTTS|MKNQSLSNTS|59|
|SEQ-ID-NO-85-CLONE-1064137|RREVYGEGKI|FDI SHRYTPE|MPAWESKEGI|GR--FLWLAAS|MKNGSLANNS|96|
|SEQ-ID-NO-95-ANNOT-1494052|RNEI YGNCKI|FDI SHRYI ND|MPVWDSKDGL|GK--FLSLPAS|MKNGSLANNS|99|

| | | | | | |
|---|---|---|---|---|---|
|SEQ-ID-NO-90-CLONE-554272|QFKLPAHSGT|HVDAPGHVFD|HYFHSGFDVD|SLDLLLNGP|ALLVDVPRDT|126|
|SEQ-ID-NO-92-CLONE-881632|EMRMPTHT GT|HI DASGHVFQ|HYFDAGFDVD|TLDLDVLNGP|ALLVDVPRDE|140|
|SEQ-ID-NO-93-GI:50944095|EMRLPTHT GT|HVDAPGHVFD|HYFDAGFDVD|SLDLEVLNGL|ALLVDVPRDD|144|
|SEQ-ID-NO-80-CLONE-8686|EMKLSVHSGT|HVDAPGHFFD|NYYDAGFDTD|SLDLQVLHGP|ALLVDVPRDK|130|
|SEQ-ID-NO-84-CLONE-954851|EMKLSVHT GT|HLDAPGHEHD|KYYDAGFDSD|SLDLQVLNGP|ALLVDVPRDK|109|
|SEQ-ID-NO-85-CLONE-1064137|EMKI PTHT GT|HVSPGHVFD|EYYDAGFDVD|SLDLOVLNGP|ALLVDVPRNK|146|
|SEQ-ID-NO-95-ANNOT-1494052|EMKLPTHT GT|HVDSPGHVFD|HYFDSGFDVD|TLDLEVLNGP|ALLVDVPRHS|149|

| | | | | | |
|---|---|---|---|---|---|
|SEQ-ID-NO-90-CLONE-554272|NI SAGVMKSL|NI PRGVRRVL|FRTLNTYRRL|MYQKEFDTSY|VGFTEDGANW|176|
|SEQ-ID-NO-92-CLONE-881632|NI TAKTMESL|HI PKGVQRVL|FRTLNTDRNL|MWKKEFDTSY|VGF MKDGAQW|190|
|SEQ-ID-NO-93-GI:50944095|NI TAKMMESL|HI PKGI QRVL|FRTLNTDRQL|MWKKEFDTSY|VGF MEDGAQW|194|
|SEQ-ID-NO-80-CLONE-8686|NI TAEVMESL|HI QRGVRRVL|FRTLNTDKRL|MFKKEFDSSF|AGF MTDGAKW|180|
|SEQ-ID-NO-84-CLONE-954851|NI X-XVMKSL|HI PKGVRRVL|FRTLNXDRRL|MFKKEFDSSF|AGF MMDGAKW|158|
|SEQ-ID-NO-85-CLONE-1064137|NI TAEVMKSL|NI PRGVRRVL|FRTLNTDRRL|MFKKEFDTSY|VGF MKDGAQW|196|
|SEQ-ID-NO-95-ANNOT-1494052|NI TAEVMKSL|HI PKGVRRVL|FRTLNTDRRL|MFKREFDRSY|VGFTKDGAKW|199|

Figure 1 - continued

| SEQ ID | col1 | col2 | col3 | col4 | col5 | pos |
|---|---|---|---|---|---|---|
| SEQ-ID-NO-90-CLONE-554272 | VENTDI KLV | GI DYLSVAAY | DHLI PAHLVF | KGREII LVE | GLKLDDVAAG | 226 |
| SEQ-ID-NO-92-CLONE-881632 | LVDNTDI KLV | GI DYLSVAAF | DDLI PSHLVL | LENRDII LVE | GLKLENVI PG | 240 |
| SEQ-ID-NO-93-GI-50944095 | LVDNTDI KLV | GI DYLSVAAF | DDLI PSHLVL | LKNRDII LVE | GLKLENI MPG | 244 |
| SEQ-ID-NO-80-CLONE-8686 | LVENTDI KLI | GLDYLSF AAF | EESPAI HRVI | LKGRDII PVE | ALKLDGVEVG | 230 |
| SEQ-ID-NO-84-CLONE-954851 | LVENTDI KLI | GLDYLSF AAY | EEAPEI HKFI | LGERDII PVE | ALKLDGVEVG | 208 |
| SEQ-ID-NO-85-CLONE-1064137 | LVDNTDI KLV | GVDYLSVAAY | DDLI PSHLVF | LKGREI LVE | GLKLDDVKAG | 246 |
| SEQ-ID-NO-95-ANNOT-1494052 | LVDNTDI KLV | GI DYLSVAAW | SDLI PSHLVF | LEGREII LVE | ALKLDDI QPG | 249 |

| SEQ ID | col1 | col2 | col3 | pos |
|---|---|---|---|---|
| SEQ-ID-NO-90-CLONE-554272 | YTVHCLPLR | LAGAEGSPI R | CI LI K | 251 |
| SEQ-ID-NO-92-CLONE-881632 | YSLHCLPLR | LRGAEGSPI R | CI LI K | 265 |
| SEQ-ID-NO-93-GI-50944095 | YSLHCLPLR | LRGAEGSPI R | CI LI K | 269 |
| SEQ-ID-NO-80-CLONE-8686 | TYSLHCLPLR | LVGAEGAPTR | CI LI K | 255 |
| SEQ-ID-NO-84-CLONE-954851 | YSLHCLPLR | LPGAEGAPTR | CI LI K | 233 |
| SEQ-ID-NO-85-CLONE-1064137 | VYSVHCLPLR | LVGAEGSPI R | CI LI G | 271 |
| SEQ-ID-NO-95-ANNOT-1494052 | VYSVHCLPLR | LFGAEGSPI R | CVLI K | 274 |

Figure 2

| | | | | | | | |
|---|---|---|---|---|---|---|---|
| SEQ-ID-252 | MGKRGKWFSA | VKKVFSSSDP | DGKEAKAQKA | DKSKSKRRWP | FGKSKHBEPS | | 50 |
| SEQ-ID-NO-301-CLONE-228069 | MGKKGKWF GA | VKKVFSPESK | EKKEERL--- | ------RR-- | ---KSAASNPA | | 37 |
| SEQ-ID-NO-302-CLONE-335348 | MGKKGKWF GA | VKKVFSPESK | EKKEE----- | ---------- | ---------- | | 25 |
| SEQ-ID-NO-100-GI-56202321 | MGKKGNWFSA | VKKVFSSSDP | DGREAKEKA_ | DKSRSRR--- | RWPFGKSK-- | | 45 |
| SEQ-ID-NO-303-GI-54306075 | MGKKGKWF GA | VKKVFSPESK | EKKEERL--- | ------RR-- | ---KLAASNPN | | 37 |
| SEQ-ID-NO-312-CLONE-1727738 | MGKKGKWF GA | VKKVFSPESK | EKKEERQ--- | ------RR-- | ---KSAASNPT | | 37 |
| SEQ-ID-NO-298-CLONE-1792902 | MGKKGKWF GA | VKKVFSPESK | EKKEERQ--- | ------RR-- | ---KSAASNPT | | 37 |
| | | | | | | | |
| SEQ-ID-252 | -ISTVPGTAP | ANA-P_PSPP | A--T------ | -QPHSLEIKD | VNPVEITDSEQ | | 89 |
| SEQ-ID-NO-301-CLONE-228069 | PVDLTPSTSL | EVNVSVPPPP | P--------- | -PPVPRQTDE | VRMPEAEQEQ | | 78 |
| SEQ-ID-NO-302-CLONE-335348 | ---------- | ---------- | ---------- | ---------- | ---------- | | 25 |
| SEQ-ID-NO-100-GI-56202321 | KSDPWTST-V | AMPTSLAPPP | QPPPPPPTHP | IQPQPEEIKD | VKAVEITDSEQ | | 94 |
| SEQ-ID-NO-303-GI-54306075 | PPDLTPSASL | EVNVSVPPPP | P--D------ | -PPVQQIEE_ | VKVPEVEQEQ | | 77 |
| SEQ-ID-NO-312-CLONE-1727738 | PRDLTPSTSL | EVNVSVPPPP | A--P------ | -PALHQIEE_ | VRI_RAPEAEQEQ | | 77 |
| SEQ-ID-NO-298-CLONE-1792902 | PLDLTPSTSL | EVNVSVPPPP | A--P------ | -PALHQIKE_ | VRI_PEAEQEQ | | 77 |
| | | | | | | | |
| SEQ-ID-252 | NKHAYSVALA | SA--VAAEA | AAVAAQAAAE | VVRLTAVTTA | APKMPVSSRE | | 135 |
| SEQ-ID-NO-301-CLONE-228069 | SKHVT-LEEA | PAAAAAPAQA | ---------- | -------SV_ | E_---PPGAPTE | | 107 |
| SEQ-ID-NO-302-CLONE-335348 | ---------- | ---------- | ---------- | ---------- | ---------- | | 25 |
| SEQ-ID-NO-100-GI-56202321 | NKHAYSVALA | SA--VAAEA | AAVAAQAAAE | VVRLTTATTA | VPKSPVSSKD | | 141 |
| SEQ-ID-NO-303-GI-54306075 | SKHVT-VEAV | PEAVPVFAQT | ---------- | --------SS | L_---PPGVSRE | | 106 |
| SEQ-ID-NO-312-CLONE-1727738 | SKHVT-VEEA | PA--APAQA | ---------- | --------SV | L_---PPGVPSE | | 103 |
| SEQ-ID-NO-298-CLONE-1792902 | SKHIT-VEEA | PA--APAQA | ---------- | --------SV | L_---PPGVPSE | | 103 |
| | | | | | | | |
| SEQ-ID-252 | ELAAIKIQTA | FRGYLARRAL | RALRGLVRLK | SLVDGNAVKR | QTAHITLQCLQ | | 186 |
| SEQ-ID-NO-301-CLONE-228069 | ELAAIKIQTA | FRGYLARRAL | RALRGLVRLK | SLVEGNSVKR | QSASTLRCMQ | | 157 |
| SEQ-ID-NO-302-CLONE-335348 | ---------- | ---------- | ---------- | ---------- | ---------- | | 25 |
| SEQ-ID-NO-100-GI-56202321 | ELAAIKIQTA | FRGYLARRAL | RALRGLVRLK | SLVDGNAVKR | QTAHITLHCLQ | | 191 |
| SEQ-ID-NO-303-GI-54306075 | EQAITKIQTA | FRGYLARRAL | RALRGLVRLK | SLVEGNSVKR | QAASTLRCMQ | | 156 |
| SEQ-ID-NO-312-CLONE-1727738 | ELAAIKIQTA | FRGYLARRAL | RALRGLVRLK | SLVEGDSVRR | QSASTLRCMQ | | 153 |
| SEQ-ID-NO-298-CLONE-1792902 | ELAAIKIQTA | FRGYLARRAL | RALRGLVRLK | SLVEGDSVRR | QSASTLRCMQ | | 153 |

Figure 2 - continued

```
SEQ:ID-252                    AMTRVQTQIY SRRVKLEEEK QALQRQLQLK HQRELEKMKI DEDWDHSHQS 236
SEQ:ID-NO-301-CLONE-228069    LSRVQSQIR  SRRAKMSEEN QALQRQLLLK -QELENFRM  GENWDDSTQS 205
SEQ:ID-NO-302-CLONE-335348                                                            25
SEQ:ID-NO-100-GI-56202321     MTRVQTQIY  SRRVKMEEEK QALQRQLLLK HQRELEKMKI DEDWDHSHQS 241
SEQ:ID-NO-303-GI-54306075     LARVQSQIR  SRRLKMSEEN QALQRQLLLK -QELESLRM  GEDWDDSTQS 204
SEQ:ID-NO-312-CLONE-1727738   LSRVQSQIR  SRRAKMSEEN QALQRQLLLK -QELENFRM  GENWDDSTQS 201
SEQ:ID-NO-298-CLONE-1792902   LSRVQSQIR  SRRAKMSEEN QALQRQLLLK -QELENFRM  GENWDDSTQS 201

SEQ:ID-252                    KEQIEANLMM KQEAALRRER ALAYAFSHQM RNSGRTIIPT FLFPGNPNWG 286
SEQ:ID-NO-301-CLONE-228069    KEQIEASLIS RQEAAIRRER ALAYAFSHQW KSTSRSANPM FVDPNNLQWG 255
SEQ:ID-NO-302-CLONE-335348                                                            25
SEQ:ID-NO-100-GI-56202321     KEQVEISLMM RQEAAVRRER ALAYAFSHQW KNSGRTIIPL FLDQGNPNWG 291
SEQ:ID-NO-303-GI-54306075     KEQIEASLIS RQEAAIRRER ALAYAFSHQW KSTSRSVNPM FVDPNNLQWG 254
SEQ:ID-NO-312-CLONE-1727738   KEQIEASLIS RQEAAIRRER ALAYAFSHQW KSTSRSVNPM FVDPNNLQWG 251
SEQ:ID-NO-298-CLONE-1792902   KEQIEASLIS RQEAAIRRER ALAYAFSHQW KSTSRSVNPM FVDPNNLQWG 251

SEQ:ID-252                    WSWMERWMIA RPWESRIAAA SDKDP-KERA VTKNASTSA- -VRVPVSRAI 333
SEQ:ID-NO-301-CLONE-228069    WSWLERWMAA KPWEGRNG-- TDKESNIDRG SVKNMSLNL- VGEGEITKAF 303
SEQ:ID-NO-302-CLONE-335348                           SNIDRG    SVKSMSLNL- -GEGEITKAF 49
SEQ:ID-NO-100-GI-56202321     WSWMERWMIS RPWESRVI-- SDKDP-KDHY SIKNPSTSA- -SRTYVPRAI 336
SEQ:ID-NO-303-GI-54306075     WSWLERWMAA KPWEGRAG-- TDKESNLDRA SAKSAGLNL- -GEGEITKAF 300
SEQ:ID-NO-312-CLONE-1727738   WSWLERWMAA KPWEGCNG-- ADKESNIDRG SVKSMSLNL- -GEGEITKAF 297
SEQ:ID-NO-298-CLONE-1792902   WSWLERWMAA KPWEGRNG-- TDKESNVDRG SVKSMSLNL- -GEGEITKAF 297

SEQ:ID-252                    ------SIQRP ATPN-KSSRP PSRQSLSTPP SKITPSASGKA RPASPRNSWL 377
SEQ:ID-NO-301-CLONE-228069    NRRDSKPEKP SPPTPKPARP ASRQSPSTPS ARVAPIPARR KSSTPKNGLS 353
SEQ:ID-NO-302-CLONE-335348    NRRDSKIEKP SPPTPRPARP TSRHSPLTPS ARVAPIPARR KSVTPKNGLS 99
SEQ:ID-NO-100-GI-56202321     ------SIQRP ATPN-KSSRP PSRQSPSTPP SRVFSVTGKI RPASPRDSWL 380
SEQ:ID-NO-303-GI-54306075     NRRDSKPDKS SPLTPK-TRP ASRQSPSTPS AKVSPIFAKK KSATPKNGLS 350
SEQ:ID-NO-312-CLONE-1727738   NRRDSKPEKP SPPTPK-TRP ASRQSPSTPS AKVAPIPARR KSATPENGLS 347
SEQ:ID-NO-298-CLONE-1792902   NRRDSKPEKP SPPTPK-TRP ASRQSPSTPS AKVAPIPVRR KSVTPKNGLS 347
```

Figure 2 - continued

| | | | | | | |
|---|---|---|---|---|---|---|
| SEQ-ID-252 | MKEDDLRSIL | SIRSERPRRQ | STGG-GSVRD | DISLTSTPPL | PSYMQSTESA | 426 |
| SEQ-ID-NO-301-CLONE-228069 | QVDDDVRSVL | SVQSERPRRH | SIATTSTMRD | DESLASSPSL | PSYMVPTESA | 403 |
| SEQ-ID-NO-302-CLONE-335348 | QVDDDARSVL | SVQSERPRRH | SIAT-STVRD | DESLTSSPSL | PSYMVPTESA | 148 |
| SEQ-ID-NO-100-GI-56202321 | MKEDDLRSIT | SIRSERPRRQ | STGG-ASVRD | DASLTSTPAL | PSYMQSTESA | 429 |
| SEQ-ID-NO-303-GI-54306075 | QVDDDAKSVF | SVQSERPRRH | SIAT-STVRD | DESLASSPSV | PSYMAPTKSA | 399 |
| SEQ-ID-NO-312-CLONE-1727738 | HVDDDARSVF | SVQSERPRRH | SIAT-STVQD | NESLASSPSL | PSYMVPTESA | 396 |
| SEQ-ID-NO-298-CLONE-1792902 | HVDDDARSVF | SVQSERPRRH | SIAT-STVRD | DESLASSPSL | PSYMVPTESA | 396 |

| | | | | | | |
|---|---|---|---|---|---|---|
| SEQ-ID-252 | RAKSRYMRSLL | LTEKLEMP-E | RAPLAHSVVK | KRLSFPVVEK | PSVVPTEKPR | 475 |
| SEQ-ID-NO-301-CLONE-228069 | RAKSRI---A | TANGAETP-E | KGGSA-GPVK | KRLSFQGGAA | A | 440 |
| SEQ-ID-NO-302-CLONE-335348 | RAKSRYRQGSA | MANGAETP-E | KGGST-GPAK | KRLSFQGGTA | A | 188 |
| SEQ-ID-NO-100-GI-56202321 | RAKSRYR-SL | LTDRFEMP-E | RVPLVHSSIK | KRLSFPVADK | PNGEHADKLM | 477 |
| SEQ-ID-NO-303-GI-54306075 | RAKLRIQGSA | VTDGAETPPE | KVASV-GSVK | KKLSFQAGMA | P | 440 |
| SEQ-ID-NO-312-CLONE-1727738 | RAKSRLQGSA | LTNGAETP-E | KGSSA-GPVK | KRLSFQGGTA | A | 436 |
| SEQ-ID-NO-298-CLONE-1792902 | RAKSRLQGSA | LNNGAETP-E | KGSSA-GPVK | KRLSFQGGTA | A | 436 |

| | | | | | |
|---|---|---|---|---|---|
| SEQ-ID-252 | ERVRRHSDPP | KVDPATKDA | AAPPQPEALV | PRA | 498 |
| SEQ-ID-NO-301-CLONE-228069 | SPMRRHSGPP | KVESA-VKDI | -APPQPEALV | ANGGSK | 476 |
| SEQ-ID-NO-302-CLONE-335348 | SPMRRHSGPP | KVEI---- | ------ | VNG-GSK | 217 |
| SEQ-ID-NO-100-GI-56202321 | ERGRRHSDPP | KVDPASL-KDV | ------ | PVS | 500 |
| SEQ-ID-NO-303-GI-54306075 | SPMRRHSGPP | KVEV---VKDI | AEPPQPEALV | NG-GSK | 474 |
| SEQ-ID-NO-312-CLONE-1727738 | SPMRRHSGPP | KVDSA-VKDI | VAPPQPEALV | NG-GSK | 471 |
| SEQ-ID-NO-298-CLONE-1792902 | SPMRRHSGPP | KVGSA-VKDI | VAPPQPEALV | NG-GSK | 471 |

Figure 3

| | | | | | | | |
|---|---|---|---|---|---|---|---|
| SEQ·ID·NO·106-CLONE·105319 | MEAATORQ | YPPWDCRKV | ECKPQRGSLR | YSQQVKVDRR | F---RGLSAR | | 48 |
| SEQ·ID·NO·107-CLONE·463638 | | | M | | | | 4 |
| SEQ·ID·NO·115-GI·76782196 | MDGKVANGLV | VSPRIGSERF | ARRTCGSVRV | SRRFREQDRL | P---VLVSAQL | | 48 |
| SEQ·ID·NO·113-GI·56805577 | NEAGVGLALQ | SRAAGFGGSD | RRRSALYGGE | GRARI | ---GSLRVAE | | 42 |
| SEQ·ID·NO·112-CLONE·749796 | MDAGVGLRPR | PRAAWAG-- | RRKPQGFPPA | TVPAVRLDQN | PARRPLVLRS | | 47 |
| SEQ·ID·NO·114-CLONE·294723 | | | | | | | 0 |
| SEQ·ID·NO·106-CLONE·105319 | LQPERIDQR | RAVSPAVSCS | DNNSSA-LLE | TGSV-YPFDE | D-LKRKAEE | | 95 |
| SEQ·ID·NO·107-CLONE·463638 | | RTTALEVSCS | YGNTSASILE | SGSVRAPLDE | ELILKNRSQE | | 44 |
| SEQ·ID·NO·115-GI·76782196 | QDKTRNSNWH | KTASLEVSCS | YKNFPASVLE | SGGIHAPFDD | ALILKNKSQE | | 98 |
| SEQ·ID·NO·113-GI·56805577 | PAVAKAAVWA | RGSKPVAPLR | AKKSSG---- | HETLHNSVDE | ALLLKRKSEE | | 89 |
| SEQ·ID·NO·112-CLONE·749796 | DAGSRSTDPI | RGASLRGLGC | HKSA------ | ---G TEKVHYSADE | ALVLKQKAED | | 92 |
| SEQ·ID·NO·114-CLONE·294723 | | | | | | | 0 |
| SEQ·ID·NO·106-CLONE·105319 | VKPYLNGRSM | YLVGMMGSGK | TTVGKLMSKV | LGYTFFDCDT | IEQAMNGTS | | 145 |
| SEQ·ID·NO·107-CLONE·463638 | QPYLNGRCI | YLVGMMGSGK | TTVGKIMSQV | LGYSFDSDA | LVEEEVGGNS | | 94 |
| SEQ·ID·NO·115-GI·76782196 | EPYLSGRCI | YLVGMMGSGK | TTVGKVLSQV | LSYAFFDSDT | VEQDVDANS | | 148 |
| SEQ·ID·NO·113-GI·56805577 | MLFYLNGRCI | YLVGMMGSCK | STVGKIMSEV | LGYSFFDSDK | VEQAVGMPS | | 139 |
| SEQ·ID·NO·112-CLONE·749796 | VLPYLNDRCV | YLVGMMGSGK | TTVGKIAEV | LGYSFFDSDK | VEQSVGIPS | | 142 |
| SEQ·ID·NO·114-CLONE·294723 | | ---MMGSGK | TTVGKILSEV | LGYSFFDSDK | VEKAVGISS | | 36 |
| SEQ·ID·NO·106-CLONE·105319 | VAEIFVHHGE | NFFFRQKETDA | LKKLSSRYQV | VVSTGGGAVI | RPINWKYMHK | | 195 |
| SEQ·ID·NO·107-CLONE·463638 | VADIFKQHGE | TFFRNKETEV | LHKLSLMHQL | VISTGGGAVI | RPINWKYMQK | | 144 |
| SEQ·ID·NO·115-GI·76782196 | VAEIFNLYGE | GFFRDKETEV | RKLSLMHRL | VVSTGGGAVV | RPINWKYMQK | | 198 |
| SEQ·ID·NO·113-GI·56805577 | VAQIFKVHSE | AFFRDNESEV | LRDLSSMHRL | VVATGGGAVI | RPVNWKYMKK | | 189 |
| SEQ·ID·NO·112-CLONE·749796 | VAEIFQVHSE | AFFRDNESEV | IAEVI | IVATGGGAVI | RPINWSYMKK | | 192 |
| SEQ·ID·NO·114-CLONE·294723 | VLFQLHSE | TFFRDNESEV | TDLSSMHRL | VVATGGGAVI | RPINWSYMKK | | 86 |
| SEQ·ID·NO·106-CLONE·105319 | GISIWLDVPL | EALAHRIAAV | GTDSRPLLHD | ESGDAYSVAF | KRLSAIWDER | | 245 |
| SEQ·ID·NO·107-CLONE·463638 | GVSVWLDVPV | EALAQRIAAV | GTNSRPLLHY | EAGDPYTRAF | MRLSALFEER | | 194 |
| SEQ·ID·NO·115-GI·76782196 | GISVWLDVPL | EALARRIAAV | GTCSRPLLHH | DSGDAYTKTF | MRLTSLMEER | | 248 |
| SEQ·ID·NO·113-GI·56805577 | GLSVWLDVPL | DALARRIAKV | GTASRPLLDQ | PSGDPYTMAF | SKLSMLAEQR | | 239 |
| SEQ·ID·NO·112-CLONE·749796 | GLTIWLDVPL | DALARRIAAV | GTASRPLLHQ | ESGDPYAKAY | AKLTALFEQR | | 242 |
| SEQ·ID·NO·114-CLONE·294723 | GLTVWLDVPL | DALARRIAAV | GTASRPLLHQ | ESGDPYAKAY | AKLTSLFEQR | | 136 |

Figure 3 - continued

| | | | | | | |
|---|---|---|---|---|---|---|
| SEQ-ID-NO-106-CLONE-105319 | GEAYT NANANAR | VSLENI AAKR | GYKNVSDLTP | TEI QI EAFEQ | VLSFL EKEET | 295 |
| SEQ-ID-NO-107-CLONE-463638 | GEAYANANANAR | VSLKNI ALKL | GKRDVSELSP | TDI AI EALEQ | DNFL KGEG | 243 |
| SEQ-ID-NO-115-GI-76782196 | SEAYANANANAR | VSLEDVAAKL | GHRDVSNLTP | TAI AI EALEQ | EGFL KEEN | 297 |
| SEQ-ID-NO-113-GI-56805577 | GDAYANADVR | VSLEEI ASKQ | GHDDVSKLTP | TDI AI ESFHK | ENFV HEHI | 288 |
| SEQ-ID-NO-112-CLONE-749796 | MDSYANADAR | VSLENI ALKQ | GHNDVNVLTP | STI AI EALLK | MESFL TEKA | 291 |
| SEQ-ID-NO-114-CLONE-294723 | MDSYANADAR | VSLEHI ALKQ | GHNDVTI LTP | STI AI EALLK | MESFL TEKT | 185 |

| | | | |
|---|---|---|---|
| SEQ-ID-NO-106-CLONE-105319 | ME) PDGDL— | ———— | 303 |
| SEQ-ID-NO-107-CLONE-463638 | GRYAEC— | ———— | 249 |
| SEQ-ID-NO-115-GI-76782196 | GDFAL— | ———— | 302 |
| SEQ-ID-NO-113-GI-56805577 | VDNPVGDSQA | DSRAQRI QTL | 308 |
| SEQ-ID-NO-112-CLONE-749796 | MVRN—— | ———— | 295 |
| SEQ-ID-NO-114-CLONE-294723 | MVRN—— | ———— | 189 |

Figure 4

```
SEQ-ID-NO-130-GI-505152        ——————————  ——————————  MADQLT DDQISEFKEA FSLFDKDGDG CITKELELGIV  36
SEQ-ID-NO-123:                 ——————————  ——————————  MASTKP TDQIKQLKDI FARFDMDKDG SLTQLELAAL   36
SEQ-ID-NO-126-CLONE-651548     ——————————  ——————————  ——MLE TDQIKQLNDI EKRFDMDQDG SLTHLELAAL    33
SEQ-ID-NO-125-ANNOT-1464081    ——————————  ——————————  —————— —————————— ————MDSDG SLTQLELAAL   15
SEQ-ID-NO-129-CLONE-759217     MTKPSPSPSP  APAKGAGSLR  GSQLKQLRSL FDRFDMDGDG SLTQLELAAL          50
SEQ-ID-NO-127-GI-50932815      MTTMAARRSE  —AAPAPQQLR  GSQLKQLREL FRRFDMNGDG SLTQLELAAL          49
SEQ-ID-NO-128-CLONE-287120     MTRSAPPASP  —PAPKP—VLR  GSQLEQLREI FRRFDMDGDG SLTQLELGAL          48

SEQ-ID-NO-130-GI-505152        MRSLGQNPTE  AELQDMINEV  DADGNGTIDF PEPLNLMARK MKDTD——————S        82
SEQ-ID-NO-123:                 LRSLGIKPRS  DQISLLLNQI  DRNGNGSVEF DELVAILPD  INEEV———LIN        84
SEQ-ID-NO-126-CLONE-651548     LRSLGIKPTG  DEIYALLSNM  DENGNGYIEF DELVHAIMPD LTESV———LIN        81
SEQ-ID-NO-125-ANNOT-1464081    LRSLGLKPTG  DQLHVLLSNM  DANGNGYVEF DELVSAILPD MNEEV———LIN        63
SEQ-ID-NO-129-CLONE-759217     LRSLGLRPTG  DESRALLLAI  DADGSGTVEF DELARAIAPV LTAHAPRLVD        100
SEQ-ID-NO-127-GI-50932815      LRSLGLRPTG  DEVHALLAGM  DANGNGSVEF DELAAAIAPL LTTQT—HLVD         98
SEQ-ID-NO-128-CLONE-287120     LRSLGLRPTG  EEARALLAAM  DSNGNGAVEF GELAAAIAPL LTTQT—HLVD         97

SEQ-ID-NO-130-GI-505152        EEELKEAFRV  FDKDQNGFIS  AAELRHVMIN LGEKLTDEEV DEMIREADVD        132
SEQ-ID-NO-123:                 QEQLMEVFRS  FDRDGNGSIT  AAELAGSMAK MGHPLTYREL TEMMTEADSN        134
SEQ-ID-NO-126-CLONE-651548     QEQLLEVFRS  FDRDGNGFIT  ASELAGSMAK MGQPLTYREL ASMMAEADSN        131
SEQ-ID-NO-125-ANNOT-1464081    QEQLLEVFRS  FDRDGNGYIT  AAELAGSMAK MGHPLTYREL SDMMREADTN        113
SEQ-ID-NO-129-CLONE-759217     QAQLLEVFRA  FDRDGNGFIS  AAELARSMAR LGQPLTFEEL RTMMRDADAD        150
SEQ-ID-NO-127-GI-50932815      QAQLLEVFRA  FDRDGNGFIS  AAELARSMAR LGQPLTFEEL TRMMRDADTD        148
SEQ-ID-NO-128-CLONE-287120     QAQLLEVFRA  FDRDGNGYIS  AAELARSMAR LGQPLTFEEL TRMMRDADAD        147

SEQ-ID-NO-130-GI-505152        GDGQINYEEF  VKVMMAK———  ——————————                                149
SEQ-ID-NO-123:                 GDGVISFNEF  SLIMAKSAAD  FLGLTAS                                   161
SEQ-ID-NO-126-CLONE-651548     GDGVISFNEF  AALMAKSAAE  FLGVKVA                                   153
SEQ-ID-NO-125-ANNOT-1464081    GDGVLSFNEF  ANVMAKSAAD  FLGIKVP                                   140
SEQ-ID-NO-129-CLONE-759217     GDGVISFGEF  AAVMARSALD  FLGVPAA                                   177
SEQ-ID-NO-127-GI-50932815      GDGVISFKEF  AAVMAKSALD  FLGVA——                                   173
SEQ-ID-NO-128-CLONE-287120     GDGVISFNEF  AAVMAKSALD  FLGVA——                                   172
```

Figure 5

```
                                                                                               50
                                                                                               46
                                                                                               35
                                                                                               35
                                                                                               39
SEQ-ID-NO-143-CLONE-1272732   METAAVAASS  AGRR MVAVD  EGEESLHALN  WCLANVVSPA  GGDTLVLHA
SEQ-ID-NO-139-CLONE-684584    MAAQAPPPPP  PEQK MVAI D  ESECSHYALE  APRRLILFTV
SEQ-ID-NO-142-CLONE-1059727   ----------  ----MVAI D  DSDCSHALR   MTLSYLKDS-  ADSDIILFT
SEQ-ID-NO-134-ANNOT-1486744   ----------  ----MVI  D  ESEYSHSFM   MVVDNLKEF   TESPLVI AA
SEQ-ID-NO-132-CLONE-2767      ----------  -MKN VMLI D  ESNASYDLI   WALENQKDT   ESSKVT FAK 90
                                                                                               89
                                                                                               75
                                                                                               83
                                                                                               89
SEQ-ID-NO-143-CLONE-1272732   RRPRPV---Y  AAMDSAG---  ----YMMTSD  VLASVERHAN  AVSAAAVDKA
SEQ-ID-NO-139-CLONE-684584    QPFSPLSY-L  PVGSPLG---  -SVASPE     LI RSVTEHQR  QLAQALVDKA
SEQ-ID-NO-142-CLONE-1059727   QPQLDLS--S  VYASSYG---  ----AAPI E  LI NSMQQNYK  NAALNR EEG
SEQ-ID-NO-134-ANNOT-1486744   PIAPNCK--F  FYGAQFGTAA  LCCPVSPTLD  LI CAI QEKNK  KI LGI LEKA
SEQ-ID-NO-132-CLONE-2767      QPQNSFTPPT  VLSSSVGFAQ  I FYPFSPNSE  LI RLAQEKNM  KI ALGI LEKA 139
                                                                                               137
                                                                                               123
                                                                                               132
                                                                                               135
SEQ-ID-NO-143-CLONE-1272732   KRVCADHPHV  KMETI VESGD  PRDVI CDAAN  KMAADLLVMG  SHG--YGF QR
SEQ-ID-NO-139-CLONE-684584    KAI CAEH--GV  DAETVI EVGD  PKEI T CEAAE  KLNVDLLI LG  SHS--RGPVQR
SEQ-ID-NO-142-CLONE-1059727   TKI CAES--GV  TPKKVMEFGN  PKEAL CDAVE  KLGVDLLI VG  SHG--KGALER
SEQ-ID-NO-134-ANNOT-1486744   VNI CASR--GV  KAET I LEAGE  PYELT CNAVQ  KNNI NLLVI G  NTSI NGTLKR
SEQ-ID-NO-132-CLONE-2767      KKI CLNH--GI  KAET FTNVGD  PKDLI RKI LQ  ERNI NLI VTS  DQQ----SLKK 162
                                                                                               160
                                                                                               146
                                                                                               182
                                                                                               150
SEQ-ID-NO-143-CLONE-1272732   ----VSNHCAQNCK  CPVLI VKR  ----------  ----------
SEQ-ID-NO-139-CLONE-684584    ----VSNYCSHHAK  CPVLVVKK  ----------  ----------
SEQ-ID-NO-142-CLONE-1059727   ----VSNYCVNKAK  CPVLVVRT  ----------  ----------
SEQ-ID-NO-134-ANNOT-1486744   ----STALESRI N   CMNI I QNELF  QELEHAGMVV  NPI NSCNKLH
SEQ-ID-NO-132-CLONE-2767      LGNFFVTSKI     CSLLVVKK  ----------  ----------R

SEQ-ID-NO-143-CLONE-1272732   --PKE    165
SEQ-ID-NO-139-CLONE-684584    --KE     162
SEQ-ID-NO-142-CLONE-1059727   --KA     148
SEQ-ID-NO-134-ANNOT-1486744   YQKH     186
SEQ-ID-NO-132-CLONE-2767      LRKD     154
```

Figure 6

```
                                                                                                              50
SEQ-ID-NO-151-GI-50944591      MAT HST SAPA   APAFSAFPLA  AAVRFPCASA  TSNT CAFSLA  EHLTREGMFF                 45
SEQ-ID-NO-152-CLONE-1551032    MAT-AVPAAC     LRAPCSSPAA  VARRLGA---  -GGPSRKRH    CAVAPVAAAC                 43
SEQ-ID-NO-146-CLONE-16403      MAVSSLSTRC--   -GGFSPTLS   HRTEILC---  -PNPSL-KAC   CLLSSGGKAD                 41
SEQ-ID-NO-147-CLONE-611156     MVVSCSL---     -SWISPCLS   HKTNLPH---  -TN--CLPRNI  ATSSSNIVFC                 42
SEQ-ID-NO-149-ANNOT-1464944    MAISSLSLSL--   -SWASTTLS   QKLSVPG---  -SNEILPRVA   AFSGNNSYTC

SEQ-ID-NO-151-GI-50944591      DLQ----SIKR    EAEER-SRRRI MLLAAGAIAMF LSWPNPAAYA   AEAKKGFLPV                 96
SEQ-ID-NO-152-CLONE-1551032    GPAPPRLDN      EEAVCL-SVRRI RVLAGAAAAF  LSRPNPAAFA  AEAKKGFLPV                 94
SEQ-ID-NO-146-CLONE-16403      SSES---TYQK    GSGNNWKRRQI A-LVGVGTLVA TSIPATLLLA  EEIPKSYSPFI                 91
SEQ-ID-NO-147-CLONE-611156     ELD---ITPSI    GESHC-RRRP   LLGIGALTA   NLGPTNLVFA  QEKPDRYPAFI                87
SEQ-ID-NO-149-ANNOT-1464944    TAE----ATFN    EESNC-KRRL   LLGVGALTT   SLVPIANFLFA EELPKNMTSFI                88

SEQ-ID-NO-151-GI-50944591      TDKKDGYSFL    YPFGWQEVVV   QGQDKVYKDV  IEPLESVSVN   TIPTSKQDIR                 146
SEQ-ID-NO-152-CLONE-1551032    VDKKAGYSFL    YPFGWEEAV    QGQDKVYKDV  IEPLESVSVN   SIPTSKEDIR                 144
SEQ-ID-NO-146-CLONE-16403      VDREDGYSYR    YPSDWREFDF   RAHDSAFKDR  YLQLQNVRVR   FIPTEKNDIH                 141
SEQ-ID-NO-147-CLONE-611156     VDYEDGYSYV    YPIDWKEFDF   RAHDSAFKDR  YLQLQNVRVR   FIPTEKKDIR                 137
SEQ-ID-NO-149-ANNOT-1464944    VDFEDGYSYI    YPSDWDFDF    RGHDSAFKDR  TKQLQNVRVR   FIPTEKKDIH                 138

SEQ-ID-NO-151-GI-50944591      ELGPPDQVAE    ALIRKVLAAP   TQKTKLIEAK  ENDVDGRIYY   TFEFTAQAPN                 196
SEQ-ID-NO-152-CLONE-1551032    DLGPPDKVAE    ALIKKVLAPS   TQKTKLIEAK  ENDVDGRAYY   TFEFTAQAPN                 194
SEQ-ID-NO-146-CLONE-16403      EVGPMEEVM     DLVKHKFAAP   NQWAT PDMK  ERVEDGKNYY   TFEYGLRTPL                 191
SEQ-ID-NO-147-CLONE-611156     DLGPMEEVII    DLVKHRYAAP   NQRPTNDMQ   EKITDGKHYY   TFEYLTSPN                  187
SEQ-ID-NO-149-ANNOT-1464944    ELGPMEE---Y   DSHMQQEIMN   VKFENFLE-N  QKTVEGKNYY   TFEYELTSPN                 185

SEQ-ID-NO-151-GI-50944591      TRHALGAIA     ANGKFYTLI    KDRLHTVVD   SFKIEAREVR                              246
SEQ-ID-NO-152-CLONE-1551032    YTRHALGAIV    ANGKFYTLI    MKDRLHTVVD  SFKIENRI---                             242
SEQ-ID-NO-146-CLONE-16403      MATTSFATVA    VGNNNRYYTLI  VKKQLQVVAD  SLKILQ-----                             238
SEQ-ID-NO-147-CLONE-611156     YSSASFATIA    IGNGRYYTLI   FRDQLKVVAD  SFRLLDI----                             234
SEQ-ID-NO-149-ANNOT-1464944    YSSVSFATIV    ANGRFYTLI    YRSQLKVVAD  SFKVLDI----                             232

SEQ-ID-NO-151-GI-50944591      FNGKCREHGS Y    257
SEQ-ID-NO-152-CLONE-1551032    ---------- -    242
SEQ-ID-NO-146-CLONE-16403      ---------- -    238
SEQ-ID-NO-147-CLONE-611156     ---------- -    234
SEQ-ID-NO-149-ANNOT-1464944    ---------- -    232
```

```
SEQ-ID-NO-168-CLONE-1064128  VSLWHFMNKF  T------PWD-  DEAHGRFCEG  VSLYGPFWEH  VLSYWRWHVD  222
SEQ-ID-NO-161-CLONE-703785   VSLWHFMNRF  AP-----SPWD- GEAL-QQFCDG VSLFGPFWEH  VLGYWRWHVE  222
SEQ-ID-NO-169-GI-77552975    VSLWHFWNRF  M------PWN-  DDAHRQFCNG  VSLFGLYWEH  VLSYWNWHVE  152
SEQ-ID-NO-160-GI-68067679    VSYYHFLRQI  VKLSVEEAPF  EEAVDEFCQG  ISSCGPYWEH  KGYWKASLE   197
SEQ-ID-NO-163-GI-1706738     VSMYHFLRQI  VKLSVEEAPF  EEAVDEFCQG  ISSCGPYWEH  LGYWKASLE   197
SEQ-ID-NO-154-CLONE-3964     VSGWHYRNML  HRTKMDQATF  ELMFDAYCRC  VLL-YGPYWEH VLSYWKGSLE  240
SEQ-ID-NO-164-GI-342004      VSIWHFGRKL  APEKTAEYP-  ETAVAAFCKG  KFI-GCPFWDH VLEYWYESLK  215
SEQ-ID-NO-157-ANNOT-1448303  SSMTFSNKL   RSETVPPI--  EEITFKMYCEG VVGFGPFWDH  MLGYWKFSLE  223

SEQ-ID-NO-168-CLONE-1064128  RPGQVLFLTY  EELSADPLGQ  LRRLAEFIGR  PFTPGEQEAG  VDREIAEACA  272
SEQ-ID-NO-161-CLONE-703785   RPEQVLFLTY  EELAADFLGQ  LKRLAAFLGR  PFTSEEREAR  VDREIVEACA  272
SEQ-ID-NO-169-GI-77552975    RPSEVLFLTY  EELAADILGH  LRRLAEFVGR  PFTTEEQDAR  VDRKIVEICA  202
SEQ-ID-NO-160-GI-68067679    KPEIFLFLKY  EDMKKDPVPS  VKKLADFIGH  PFTPKEEEAG  VIEDIVKLCS  247
SEQ-ID-NO-163-GI-1706738     KPEIFLFLKY  EDMKKDPVPS  VKKLADFIGH  PFTPKEEEAG  VIENIKLCS   247
SEQ-ID-NO-154-CLONE-3964     AKENVLFMKY  EEILEEPRVQ  VKRLAEFLEC  PFTKEEEESG  SVEEILKLCS  290
SEQ-ID-NO-164-GI-342004      NFNKVLFVTY  EELKKQTEVE  VKKRIAEFIGC GFTAEEE---  -VSEIVKLCS  261
SEQ-ID-NO-157-ANNOT-1448303  BQDKVLFLKY  EDMKADVTFY  LKKIAKFLGC  PFSMEEEKEG  VVEKIASLCS  273

SEQ-ID-NO-168-CLONE-1064128  MKSMVNQEVN  QSRTTEIVE-  MPIPNGIFFR  RGVVGDWINY  LTPEMAGRID  321
SEQ-ID-NO-161-CLONE-703785   MESLAGLEVN  RSGKTDMTE-  SSVANNIFFR  RGVVGDWKNH  LTPEMARRID  321
SEQ-ID-NO-169-GI-77552975    MESLSGLEVN  RSGMINFTK-  KDWPNNISFR  RGVGDWRNH   LTPEMARRI   251
SEQ-ID-NO-160-GI-68067679    FEKLSSLEVN  KSGMHRPEEA  HSIENRLYFR  KGKDGDWKNY  FTDEMTQKI   297
SEQ-ID-NO-163-GI-1706738     FEKLSSLEVN  KSGMHRPEEA  HSIENRLYFR  KGKDGDWKNY  FTDEMTQKI   297
SEQ-ID-NO-154-CLONE-3964     LRNLSNLEVN  KNGITR----  GVDSQVFFR   KGEVGDWKNH  LTPQMAKITFD 336
SEQ-ID-NO-164-GI-342004      FESLSSLEVN  RQGKLP----  NGIESNAFFR  KGEGWRDI    SESLADVID   307
SEQ-ID-NO-157-ANNOT-1448303  EEKMRNLEVN  KSGRSI----  TNFENKIHLFR KAEVGDWINY  LSPSMVKQLS  319

SEQ-ID-NO-168-CLONE-1064128  EITKSKFEGS  GLMLPKTISE  ISKI------                          345
SEQ-ID-NO-161-CLONE-703785   EITDSKFRGS  GLALTPATAD  QN--------                          343
SEQ-ID-NO-169-GI-77552975    EITEVKFKGS  GLLLHPPFLQ  VKRELNEL--                          279
SEQ-ID-NO-160-GI-68067679    KLIDEKLGAT  GLVLK-----  ----------                          312
SEQ-ID-NO-163-GI-1706738     ELIDEKLGAT  GLVLK-----  ----------                          312
SEQ-ID-NO-154-CLONE-3964     RITEQKFGGS  GLKFSS----  ----------                          351
SEQ-ID-NO-164-GI-342004      OLIEEKLGGS  SGVQAAAAAA  SSSSSVIKKK  FELQRYGENK  NTNVN       323
SEQ-ID-NO-157-ANNOT-1448303                                                              364
```

FIGURE 8

```
SEQ-ID-NO-172-CLONE-965405    MSADDSSNAI  DVDGKLGSDL  NMNSDGEDAA  DNDSSKTLT-  PAPAVCLVR   49
SEQ-ID-NO-173-CLONE-5367      MAANDSSNAI  DIDGNLDSDS  NLNTDGGEAT  DNDSSSKALVT PAPAVCLFR   50
SEQ-ID-NO-174-GI-79537394     MAAENSSNAI  NVDTSLDSDS  KPNRDANDMT  DHDSSSKALV  PAPAVCLVR   50
SEQ-ID-NO-175-GI-9758183      MAAENSSNAI  NVDTSLDSDS  KPNRDANDMT  DHDSSSKALV  IPAPAVCLVR  50
SEQ-ID-NO-176-CLONE-1060894   MAAENPSNGV  DVDTSLASDS  NDNRKASDLT  NHDSS-MALI  VPSTAVCLGR  49
SEQ-ID-NO-179-ANNOT-1494390   MATANSPNTS  NNSDSDVEDP  NPNPSSN--N  NNASTIPSAE  SSTPSVCLIR  48
SEQ-ID-NO-177-CLONE-639280    MAAR-SENES  DCDDVG----  T--------   --SLSLPPL   AAGPAVCVLR  39

SEQ-ID-NO-172-CLONE-965405    FAGDAAGGAV  MGSIFGYCSG  LFKKKGFKGS  FADAGQSAKT  FAVLSGVHSL  99
SEQ-ID-NO-173-CLONE-5367      FAGDAAGGAV  MGSIFGYCSG  LFKKKGFKGS  FADAGQSAKT  FAVLSGVHSL  100
SEQ-ID-NO-174-GI-79537394     FAGDAASGAF  MGSVFGYCSG  LFKKKGFKGS  FVDAGQSAKT  FAVLSGVHSL  100
SEQ-ID-NO-175-GI-9758183      FAGDAASGAF  MGSVFGYG--  ---------  ---------  ---------   98
SEQ-ID-NO-176-CLONE-1060894   FAGDAAGGAF  MGSIFGYCSG  LFKKKGFKGS  FADAGQSAKN  FAILSGVHSL  99
SEQ-ID-NO-179-ANNOT-1494390   FAGDSAAGAF  MGSIFGYCSG  LFKKKGFKGS  FGEAGSCAKT  FAVLSGVHSL  98
SEQ-ID-NO-177-CLONE-639280    SAGDFFAGGAF VGSIFGYGQG LLSKKGLKGS  LGNAGSSAKS  FAVLSGVQSL  89

SEQ-ID-NO-172-CLONE-965405    VVCLLKQLRG  KDDAINVGVA  GCCTGLALSF  PGAPQALLQS  CLTFGAFSFI  149
SEQ-ID-NO-173-CLONE-5367      VVCLLKQIRG  KDDAINVGVA  GCCTGLALSF  PGAPQALLQS  CLTFGAFSFI  150
SEQ-ID-NO-174-GI-79537394     VVCLLKQIRG  KDDAINVGVA  GCCTGLALSF  PGAPQAMLQS  CLTFGAFSFI  150
SEQ-ID-NO-175-GI-9758183      VVCLLKKLRG  KDDAINVGIA  GCCTGLALSY  PGAPQAMLQS  CVTFGAFSFI  148
SEQ-ID-NO-176-CLONE-1060894   VVCFLKRLRG  KDDVNAGVA   GCCTGLALSF  PGAPQALLQS  CLTFGAFSFI  149
SEQ-ID-NO-179-ANNOT-1494390   VVCLLKLRG   KDDINSGIA   GCCTGLALSF  PGAPQALLOS  CLTFGAFSFI  148
SEQ-ID-NO-177-CLONE-639280    VLCLLRKLRG  ---------  GCCTGLALSF  PGTPQALLQN  CATFAAFSCL  139

SEQ-ID-NO-172-CLONE-965405    LEGLNKRQTA  LAHSVSLR-H  QTGNFGDHQQ  RPLQLSLALP  HEEIKGL-FS  197
SEQ-ID-NO-173-CLONE-5367      LEGLNKRQTA  LAHSVSLR-H  QTGLFQDHH-  RALPLSLALP  PEEIKGAFS   198
SEQ-ID-NO-174-GI-79537394     LEGLNKRQTA  LAHSVSFR-Q  QTRSP----  DLPLLSLAIP  HDEIKGAFS   196
SEQ-ID-NO-175-GI-9758183      LEGLNKRQTA  LAHSVSFR-Q  QTRSP----  DLPLLSLAIP  HDEIKGAFS   194
SEQ-ID-NO-176-CLONE-1060894   EGLNKRQTA   LAHSVSSRHD  QTRSL----  DLP-SLALP   HEEIKGAFS   195
SEQ-ID-NO-179-ANNOT-1494390   EGLNKKQAA   LAHSISSRN   KCDYHS----  CPLALPLSVP  LPDELKGAFS  195
SEQ-ID-NO-177-CLONE-639280    MEGLNKQQTA  MAHTLTGN-A  LTFAH----  GAGVLPPSLS  PQSSMLPMLS  185
```

Figure 8 - continued

| | | |
|---|---|---|
| SEQ-ID-NO-172-CLONE-965405 | SFCKSLTKPK | KI------ 209 |
| SEQ-ID-NO-173-CLONE-5367 | SFCKSLAKPR | KF------ 210 |
| SEQ-ID-NO-174-GI-795373394 | SFCNSLTKPK | KLKFPHAR- 214 |
| SEQ-ID-NO-175-GI-9758183 | SFCNSLTKPK | KLKFPHAR- 212 |
| SEQ-ID-NO-176-CLONE-1060894 | SFCKSLTKPK | KLAFPSSR- 213 |
| SEQ-ID-NO-179-ANNOT-1494390 | FFCKSLRKPK | SANFPAAAP 214 |
| SEQ-ID-NO-177-CLONE-639280 | PHAARPWSPS | LRSTRQQH- 203 |

Figure 9

| | | | | | | | |
|---|---|---|---|---|---|---|---|
| SEQ-ID-NO-304-CLONE-335348-T | -ESNI DRGSV | KSMSLNL--G | EGEITKAFNR | RDSKLEKPSP | PTPRPARPTS | 47 |
| SEQ-ID-NO-305-CLONE-228069-T | -ESNI DRGSV | KNMSLNLGVG | EGEITKAFNR | RDSKPEKPSP | PTPKPARPAS | 49 |
| SEQ-ID-NO-306-CLONE-375578-T | -DP-KERAVT | KNASTSA--V | RVPVSRA--- | -STQRPAI-- | PN-KSSRPPS | 40 |
| SEQ-ID-NO-307-CLONE-229668-T | -ESNI DRGSV | KSMSLNL--G | EGEITKAFNR | RDSKLEKPSP | PTPRPARPTS | 47 |
| SEQ-ID-NO-308-GI-54306075-T | -ESNLDRASA | KSASLNL--G | EGEITKAFNR | RGSKPDKSSP | TTPKLTRPAS | 47 |
| SEQ-ID-NO-309-GI-56202321-T | -DP-KDHYST | KNPSSA---S | RTYVPRA--- | -STQRPAI-- | PN-KSSRPPS | 40 |
| SEQ-ID-NO-310-CLONE-1792902-T | -ESNVDRGSV | KSMSLNL--G | EGEITKAFNR | RDSKPEKPSP | PTPKLTRPAS | 47 |
| SEQ-ID-NO-311-CLONE-1727738-T | KESNI DRGSV | KSMSLNL--G | EGEITKAFNR | RDSKPEKPSP | PTPKLTRPAS | 48 |
| | | | | | | | |
| SEQ-ID-NO-304-CLONE-335348-T | RHSPLTPSAR | VAPI PARRKS | VTPKNGLSQV | DDDARSVLSV | QSERPRRHSI | 97 |
| SEQ-ID-NO-305-CLONE-228069-T | RQSPSTPSAR | VAPI PARRKS | STPKNGLSQV | DDDVRSVLSV | QSERPRRHSI | 99 |
| SEQ-ID-NO-306-CLONE-375578-T | RQSSTPPSK | TPSASGKARP | ASPRNSWLYK | EDDLRSITSI | RSERPRRQST | 90 |
| SEQ-ID-NO-307-CLONE-229668-T | RHSPLTPSAR | VAPI PARRKS | VTPKNGLSQV | DDDARSVLSV | QSERPRRHSI | 97 |
| SEQ-ID-NO-308-GI-54306075-T | RQSPSTPSAK | VSPI FAKKKS | ATPKNGLSQV | DDDAKSVFSV | QSERPRRHSI | 97 |
| SEQ-ID-NO-309-GI-56202321-T | RQSPSTPPSR | VPSVTGKI RP | ASPRDSWLYK | EDDLRSITSI | RSERPRRQST | 90 |
| SEQ-ID-NO-310-CLONE-1792902-T | RQSPSTPSAK | VAPI PVRRKS | VTPENGLSHV | DDDARSVFSV | QSERPRRHSI | 97 |
| SEQ-ID-NO-311-CLONE-1727738-T | RQSPSTPSAK | VAPI PARRKS | ATPENGLSHV | DDDARSVFSV | QSERPRRHSI | 98 |
| | | | | | | | |
| SEQ-ID-NO-304-CLONE-335348-T | AT--STVRDDE | SLTSSPSLPS | YMVPTESARA | KSRLQGSAMA | NGAETP-EKG | 145 |
| SEQ-ID-NO-305-CLONE-228069-T | AT--STMRDDE | SLASSPSLPS | MVPTESARA | KSR----TATA | NGAETP-EKG | 145 |
| SEQ-ID-NO-306-CLONE-375578-T | GG--GSVRDDT | SLTSTPPLPS | MQSTESARA | KSRYRSLLLT | EKLEVP-ERA | 138 |
| SEQ-ID-NO-307-CLONE-229668-T | AT--STVRDDE | SLTSSPSLPS | MVPTESARA | KSRLQGSAVT | NGAETP-EKG | 145 |
| SEQ-ID-NO-308-GI-54306075-T | AT--STVRDDE | SLASSPSVPS | MAPTKSARA | KLRLQGSAVT | DGAETP-PEKV | 146 |
| SEQ-ID-NO-309-GI-56202321-T | GG--ASVRDDA | SLTSTPALPS | MQSTESARA | KSRYRSLI-T | DRFEVP-ERV | 137 |
| SEQ-ID-NO-310-CLONE-1792902-T | AT--STVRDDE | SLASSPSLPS | MVPTESARA | KSRLQGSALN | NGAETP-EKG | 145 |
| SEQ-ID-NO-311-CLONE-1727738-T | AT--STVODNE | SLASSPSLPS | MVPTESARA | KSRLQGSALT | NGAETP-EKG | 146 |
| | | | | | | | |
| SEQ-ID-NO-304-CLONE-335348-T | GST--GPAKKR | LSFQGGTAA- | --------- | MRRHSGPPKV | EL------AP | 180 |
| SEQ-ID-NO-305-CLONE-228069-T | GSA--GPVKKR | LSFQGGTAA- | --------- | MRRHSGPPKV | ESAVKDIAAP | 186 |
| SEQ-ID-NO-306-CLONE-375578-T | PLAH-SVVKKR | LSFPVVEKPS | VVPTEKPRER | VRRHSDPPKV | DPA------ | 181 |
| SEQ-ID-NO-307-CLONE-229668-T | GST--GPAKKR | LSFQGGTAA- | --------- | MRRHSGPPKV | EV-VKDIAEP | 180 |
| SEQ-ID-NO-308-GI-54306075-T | ASV--GSVKKR | LSFQAGMAP- | --------- | MRRHSGPPKV | ERV------ | 186 |
| SEQ-ID-NO-309-GI-56202321-T | PLVHSSI KKR | LSFVADKPN | GEHADKLMER | GRRHSDPPKV | DRFEVP--- | 180 |
| SEQ-ID-NO-310-CLONE-1792902-T | SSA--GPVKKR | LSFQGGTAA- | --------- | MRRHSGPPKV | GSAVKDIVAP | 186 |
| SEQ-ID-NO-311-CLONE-1727738-T | SSA--GPVKKR | LSFQGGTAA- | -ASP------ | MRRHSGPPKV | DSAVKDIVAP | 187 |

Figure 9 - continued

| | | | |
|---|---|---|---|
| SEQ-ID-NO-304-CLONE-335348-T | PQPEALVVNG | -GSK | 193 |
| SEQ-ID-NO-305-CLONE-228069-T | PQPEALVANG | GGSK | 200 |
| SEQ-ID-NO-306-CLONE-375578-T | TLKDA | -PAA | 189 |
| SEQ-ID-NO-307-CLONE-229668-T | PQPEALVVNG | -GSK | 193 |
| SEQ-ID-NO-308-GI-54306075-T | PQPEALVING | -GSK | 199 |
| SEQ-ID-NO-309-GI-56202321-T | SLKDV | -PVS | 188 |
| SEQ-ID-NO-310-CLONE-17929D2-T | PQPEALVING | -GSK | 199 |
| SEQ-ID-NO-311-CLONE-1727738-T | PQPEALVING | -GSK | 200 |

NUCLEOTIDE SEQUENCES AND CORRESPONDING POLYPEPTIDES CONFERRING MODULATED GROWTH RATE AND BIOMASS IN PLANTS GROWN IN SALINE CONDITIONS

This Application is the National Phase Under 35 U.S.C. §371 of PCT International Application No. PCT/US2007/006544 which has an International filing date of Mar. 14, 2007, which claims priority to U.S. Provisional Application No. 60/782,735 filed on Mar. 14, 2006. The entire contents of all applications listed above are hereby incorporated by reference.

FIELD OF THE INVENTION

The present invention relates to isolated nucleic acid molecules and their corresponding encoded polypeptides able to enhance plant growth under saline conditions. The present invention further relates to using the nucleic acid molecules and polypeptides to make transgenic plants, plant cells, plant materials or seeds of a plant having improved growth rate, vegetative growth, seedling vigor and/or biomass under saline conditions as compared to wild-type plants grown under similar conditions.

BACKGROUND OF THE INVENTION

Plants specifically improved for agriculture, horticulture, biomass conversion, and other industries (e.g. paper industry, plants as production factories for proteins or other compounds) can be obtained using molecular technologies. As an example, great agronomic value can result from enhancing plant growth in saline conditions.

A wide variety agriculturally important plant species demonstrate significant sensitivity to saline water and/or soil. Upon salt concentration exceeding a relatively low threshold, many plants suffer from stunted growth, necrosis, and death that results in an overall stunted appearance and reduced yields of plant material, seeds, fruit and other valuable products. Physiologically, plants challenged with salinity experience disruption in ion and water homeostasis, inhibition of metabolism, and damage to cellular membranes that result in developmental arrest and cell death (Huh et al. (2002) *Plant J*, 29(5):649-59).

In many of the world's most productive agricultural regions, agricultural activities themselves lead to increased water and soil salinity, which threatens their sustained productivity. One example is crop irrigation in arid regions that have abundant sunlight. After irrigation water is applied to cropland, it is removed by the processes of evaporation and evapotranspiration. While these processes remove water from the soil, they leave behind dissolved salts carried in irrigation water. Consequently, soil and groundwater salt concentrations build over time, rendering the land and shallow groundwater saline and thus damaging to crops.

In addition to human activities, natural geological processes have created vast tracts of saline land that would be highly productive if not saline. In total, approximately 20% of the irrigated lands in are negatively affected by salinity. (Yamaguchi and Blumwald, 2005, *Trends in Plant Science*, 10: 615-620). For these and other reasons, it is of great interest and importance to identify genes that confer improved salt tolerance characteristics to thereby enable one to create transgenic plants (such as crop plants) with enhanced growth and/or productivity characteristics in saline conditions.

The availability and sustainability of a stream of food and feed for people and domesticated animals has been a high priority throughout the history of human civilization and lies at the origin of agriculture. Specialists and researchers in the fields of agronomy science, agriculture, crop science, horticulture, and forest science are even today constantly striving to find and produce plants with an increased growth potential to feed an increasing world population and to guarantee a supply of reproducible raw materials. The robust level of research in these fields of science indicates the level of importance leaders in every geographic environment and climate around the world place on providing sustainable sources of food, feed and energy.

Manipulation of crop performance has been accomplished conventionally for centuries through selection and plant breeding. The breeding process is, however, both time-consuming and labor-intensive. Furthermore, appropriate breeding programs must be specially designed for each relevant plant species.

On the other hand, great progress has been made in using molecular genetic approaches to manipulate plants to provide better crops. Through the introduction and expression of recombinant nucleic acid molecules in plants, researchers are now poised to provide the community with plant species tailored to grow more efficiently and yield more product despite suboptimal geographic and/or climatic environments. These new approaches have the additional advantage of not being limited to one plant species, but instead being applicable to multiple different plant species (Zhang et al. (2004) *Plant Physiol*. 135:615; Zhang et al. (2001) *Proc. Natl. Acad. Sci. USA* 98:12832).

Despite this progress, today there continues to be a great need for generally applicable processes that improve forest or agricultural plant growth to suit particular needs depending on specific environmental conditions. To this end, the present invention is directed to advantageously manipulating plant tolerance to salinity in order to maximize the benefits of various crops depending on the benefit sought, and is characterized by expression of recombinant DNA molecules in plants. These molecules may be from the plant itself, and simply expressed at a higher or lower level, or the molecules may be from different plant species.

SUMMARY OF THE INVENTION

The present invention, therefore, relates to isolated nucleic acid molecules and polypeptides and their use in making transgenic plants, plant cells, plant materials or seeds of plants having improved growth characteristics in saline conditions compared to wild-type plants under similar or identical conditions.

The present invention also relates to processes for increasing the growth potential of plants challenged with saline conditions due to salt tolerance derived from recombinant nucleic acid molecules and polypeptides. The phrase "increasing growth potential" refers to continued growth in saline conditions, better yield after exposure to saline conditions and/or increased vigor in saline conditions.

Unless otherwise defined, all technical and scientific terms used herein have the same meaning as commonly understood by one of ordinary skill in the art to which this invention belongs.

BRIEF DESCRIPTION OF THE FIGURES

FIG. 1 Amino acid sequence alignment of homologues of Ceres clone 8686 (SEQ ID NO: 80). Conserved regions are enclosed in a box.

FIG. 2. Amino acid sequence alignment of homologues of Ceres clone 375578 (SEQ ID NO: 252). Conserved regions are enclosed in a box.

FIG. 3. Amino acid sequence alignment of homologues of Ceres clone 105319 (SEQ ID NO: 106). Conserved regions are enclosed in a box.

FIG. 4 Amino acid sequence alignment of homologues of Ceres clone 29658 (SEQ ID NO: 123). Conserved regions are enclosed in a box.

FIG. 5 Amino acid sequence alignment of homologues of Ceres clone 2767 (SEQ ID NO: 132). Conserved regions are enclosed in a box.

FIG. 6 Amino acid sequence alignment of homologues of Ceres clone 16403 (SEQ ID NO: 146). Conserved regions are enclosed in a box.

FIG. 7 Amino acid sequence alignment of homologues of Ceres clone 3964 (SEQ ID NO: 154). Conserved regions are enclosed in a box.

FIG. 8. Amino acid sequence alignment of homologues of Ceres clone 965405 (SEQ ID NO: 172). Conserved regions are enclosed in a box.

FIG. 9. Amino acid sequence alignment of a conserved region of Ceres clones 375578 (SEQ ID NO: 306) and 335348 (SEQ ID NO: 304) and homologues. Conserved regions are enclosed in a box.

DETAILED DESCRIPTION OF THE INVENTION

1. The Invention

The present invention discloses novel isolated nucleic acid molecules, nucleic acid molecules that interfere with these nucleic acid molecules, nucleic acid molecules that hybridize to these nucleic acid molecules, and isolated nucleic acid molecules that encode the same protein due to the degeneracy of the DNA code. Additional embodiments of the present application further include the polypeptides encoded by the isolated nucleic acid molecules of the present invention.

Figure 7:
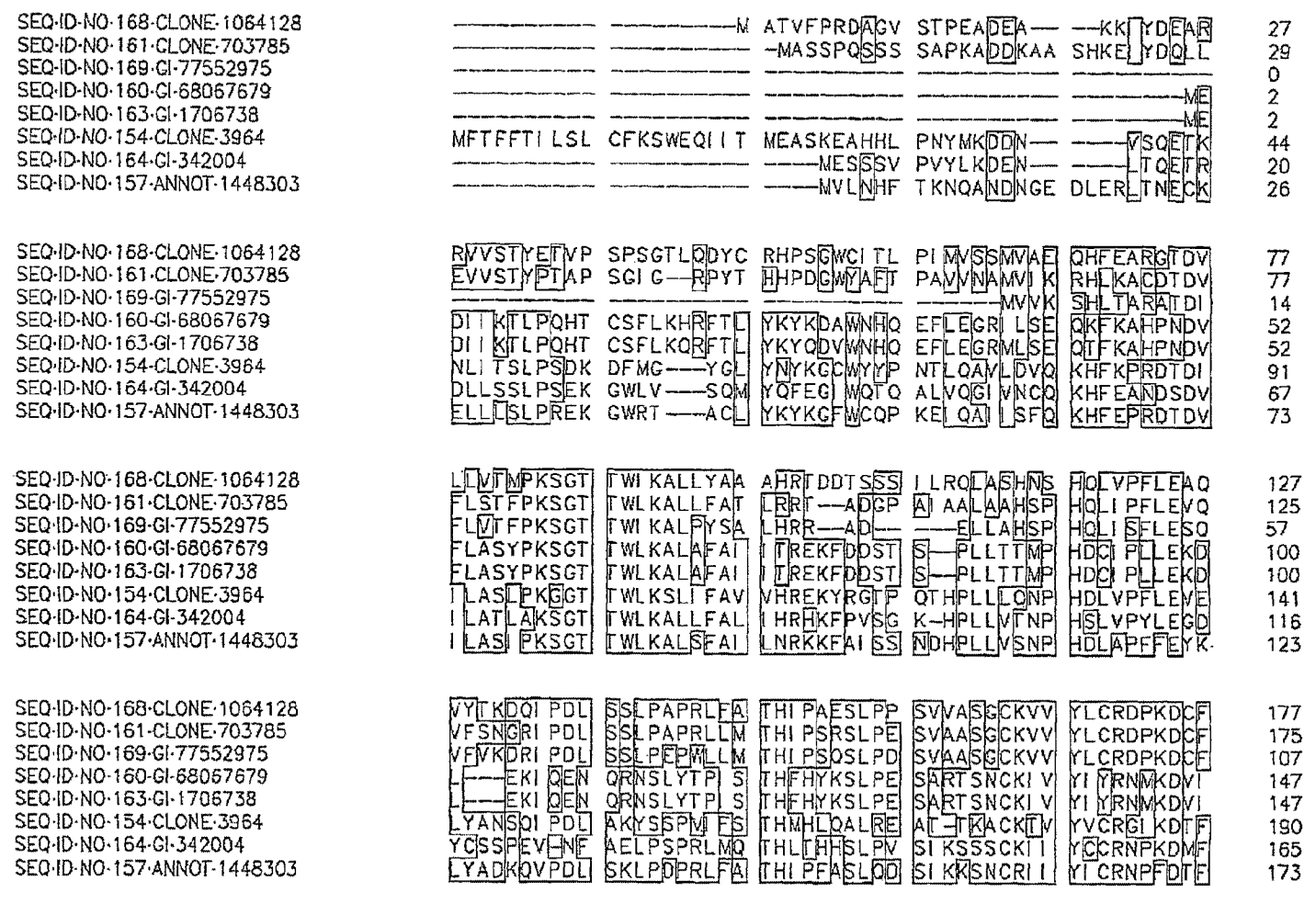

More particularly, the nucleic acid molecules of the present invention comprise: (a) a nucleotide sequence that encodes an amino acid sequence and that is at least 85% identical to any one of SEQ ID Nos. 80, 99, 106, 123, 132, 146, 154 and 172 respectively, (b) a nucleotide sequence that is complementary to any one of the nucleotide sequences according to (a), (c) a nucleotide sequence according to any one of SEQ ID NOs. 79, 98, 105, 122, 131, 145, 153 and 171, (d) a nucleotide sequence able to interfere with any one of the nucleotide sequences according to (a), (e) a nucleotide sequence able to form a hybridized nucleic acid duplex with the nucleic acid according to any one of paragraphs (a)-(d) at a temperature from about 5° C. to about 10° C. below a melting temperature of the hybridized nucleic acid duplex, (f) a nucleotide sequence encoding any one of amino acid sequences of SEQ ID NOS. 80, 99, 106, 123, 132, 146, 154 and 172, (g) a nucleotide sequence encoding any one of the amino acid sequences with an HMM bit score greater than 20 that fits an HMM based on the sequences aligned in any one of FIGS. 1-8, and (h) a nucleotide sequence encoding an amino acid sequence having a fragment that fits an HMM based on the sequences aligned in FIG. 9 and which has an HMM bit score greater than 400.

Additional embodiments of the present invention include those polypeptide and nucleic acid molecule sequences disclosed in SEQ ID NOs: 81-97, 100-104, 107-121, 124-130, 133-144, 147-152, 155-170, 173-252 and 269-315.

The present invention further embodies a vector comprising a first nucleic acid having a nucleotide sequence encoding a plant transcription and/or translation signal, and a second nucleic acid having a nucleotide sequence according to the isolated nucleic acid molecules of the present invention. More particularly, the first and second nucleic acids may be operably linked. Even more particularly, the second nucleic acid may be endogenous to a first organism, and any other nucleic acid in the vector may be endogenous to a second organism. Most particularly, the first and second organisms may be different species.

In a further embodiment of the present invention, a host cell may comprise an isolated nucleic acid molecule according to the present invention. More particularly, the isolated nucleic acid molecule of the present invention found in the host cell of the present invention may be endogenous to a first organism and may be flanked by nucleotide sequences endogenous to a second organism. Further, the first and second organisms may be different species. Even more particularly, the host cell of the present invention may comprise a vector according to the present invention, which itself comprises nucleic acid molecules according to those of the present invention.

In another embodiment of the present invention, the isolated polypeptides of the present invention may additionally comprise amino acid sequences that are at least 85% identical to any one of SEQ ID Nos. 80, 99, 106, 123, 132, 146, 154 and 172.

Other embodiments of the present invention include methods of introducing an isolated nucleic acid of the present invention into a host cell. More particularly, an isolated nucleic acid molecule of the present invention may be contacted to a host cell under conditions allowing transport of the isolated nucleic acid into the host cell. Even more particularly, a vector as described in a previous embodiment of the present invention may be introduced into a host cell by the same method.

Methods of detection are also available as embodiments of the present invention. Particularly, methods for detecting a nucleic acid molecule according to the present invention in a sample. More particularly, the isolated nucleic acid molecule according to the present invention may be contacted with a sample under conditions that permit a comparison of the nucleotide sequence of the isolated nucleic acid molecule with a nucleotide sequence of nucleic acid in the sample. The results of such an analysis may then be considered to determine whether the isolated nucleic acid molecule of the present invention is detectable and therefore present within the sample.

A further embodiment of the present invention comprises a plant, plant cell, plant material or seeds of plants comprising an isolated nucleic acid molecule and/or vector of the present invention. More particularly, the isolated nucleic acid molecule of the present invention may be exogenous to the plant, plant cell, plant material or seed of a plant.

A further embodiment of the present invention includes a plant regenerated from a plant cell or seed according to the present invention. More particularly, the plant, or plants derived from the plant, plant cell, plant material or seeds of a plant of the present invention preferably has increased size (in whole or in part), increased vegetative growth and/or increased biomass (sometimes hereinafter collectively referred to as increased biomass) in saline conditions, as compared to a wild-type plant cultivated under identical conditions. Furthermore, the transgenic plant may comprise a first isolated nucleic acid molecule of the present invention, which encodes a protein involved in improving growth and phenotype characteristics in saline conditions, and a second isolated nucleic acid molecule which encodes a promoter capable of driving expression in plants, wherein the growth and phenotype improving component and the promoter are operably linked. More preferably, the first isolated nucleic acid may be mis-expressed in the transgenic plant of the present invention, and the transgenic plant exhibits improved characteristics as compared to a progenitor plant devoid of the polynucleotide, when the transgenic plant and the progenitor plant are cultivated under identical, saline conditions. In another embodiment of the present invention the improved growth and phenotype characteristics may be due to the inactivation of a particular sequence, using for example an interfering RNA.

A further embodiment consists of a plant, plant cell, plant material or seed of a plant according to the present invention which comprises an isolated nucleic acid molecule of the present invention, wherein the plant, or plants derived from the plant, plant cell, plant material or seed of a plant, has the improved growth and phenotype characteristics in saline conditions as compared to a wild-type plant cultivated under identical conditions.

The polynucleotide conferring increased biomass or vigor in saline conditions may be mis-expressed in the transgenic plant of the present invention, and the transgenic plant exhibits an increased biomass or vigor as compared to a progenitor plant devoid of the polynucleotide, when the transgenic plant and the progenitor plant are cultivated under identical saline conditions. In another embodiment of the present invention increased biomass or vigor phenotype may be due to the inactivation of a particular sequence, using for example an interfering RNA.

Another embodiment consists of a plant, plant cell, plant material or seed of a plant according to the present invention which comprises an isolated nucleic acid molecule of the present invention, wherein the plant, or plants derived from the plant, plant cell, plant material or seed of a plant, has increased biomass or vigor in saline conditions as compared to a wild-type plant cultivated under identical conditions.

Another embodiment of the present invention includes methods of enhancing biomass or vigor in plants challenged with saline conditions. More particularly, these methods comprise transforming a plant with an isolated nucleic acid molecule according to the present invention. Preferably, the method is a method of enhancing biomass or vigor in the transgenic plant, whereby the plant is transformed with a nucleic acid molecule encoding the polypeptide of the present invention.

Polypeptides of the present invention include sequences belonging to the consensus sequence families shown in FIGS. 1-9 as delineated by Hidden Markov Models (HMMs).

2. DEFINITIONS

The following terms are utilized throughout this application:

Functionally Comparable Proteins or Functional Homologs: This phrase describes a set of proteins that perform similar functions within an organism. By definition, perturbation of an individual protein within that set (through misexpression or mutation, for example) is expected to confer a similar phenotype as compared to perturbation of any other individual protein. Such proteins typically share sequence similarity resulting in similar biochemical activity. Within this definition, homologs, orthologs and paralogs are considered to be functionally comparable.

Functionally comparable proteins will give rise to the same characteristic to a similar, but not necessarily the same, degree. Typically, comparable proteins give the same characteristics where the quantitative measurement due to one of the comparables is at least 20% of the other; more typically, between 30 to 40%; even more typically, between 50-60%; even more typically between 70 to 80%; even more typically between 90 to 100% of the other.

Heterologous sequences: "Heterologous sequences" are those that are not operatively linked or are not contiguous to each other in nature. For example, a promoter from corn is considered heterologous to an *Arabidopsis* coding region sequence. Also, a promoter from a gene encoding a growth factor from corn is considered heterologous to a sequence encoding the corn receptor for the growth factor. Regulatory element sequences, such as UTRs or 3' end termination sequences that do not originate in nature from the same gene as the coding sequence, are considered heterologous to said coding sequence. Elements operatively linked in nature and contiguous to each other are not heterologous to each other. On the other hand, these same elements remain operatively linked but become heterologous if other filler sequence is placed between them. Thus, the promoter and coding sequences of a corn gene expressing an amino acid transporter are not heterologous to each other, but the promoter and coding sequence of a corn gene operatively linked in a novel manner are heterologous.

Hidden Markov Model (HMM): HMM is a statistical description of a sequence family's consensus. The model is indicative of similarity of a polypeptide sequence to a group of structurally and functionally related polypeptides (Durbin, R., Eddy, S. R., Krogh, A. & Mitchison, G. J. *Biological Sequence Analysis. Probabilistic Models of Proteins and Nucleic Acids* Cambridge University Press, Cambridge UK, 1998).

HMM based on specified sequences: An HMM profile based on specified sequences is the output model generated by the program HMMER 2.3.2 (released Oct. 3, 2003 under a GNU general public license, and available from various sources, such as the HMMER website on the internet) configured with default parameters, the model being built by the program using as input the specified sequences. The program outputs the model as a text file.

HMM bit score: An HMM bit score is a probabilistic indication of confidence that a sequence fits the model. The bit score reflects whether the sequence is a better fit to an HMM of interest than to a null model of nonhomologous sequences. A significant HMM bit score is greater than zero, but is typically greater than 20. The HMM bit score of a polypeptide sequence fitted to an HMM profile can be determined by fitting the polypeptide to the HMM with program HMMER 2.3.2 configured for global alignments.

Misexpression: The term "misexpression" refers to an increase or a decrease in the transcription of a coding region into a complementary RNA sequence as compared to the wild-type. This term also encompasses expression and/or translation of a gene or coding region or inhibition of such transcription and/or translation for a different time period as compared to the wild-type and/or from a non-natural location within the plant genome, including a gene or coding region from a different plant species or from a non-plant organism.

Percentage of sequence identity: As used herein, the term "percent sequence identity" refers to the degree of identity between any given query sequence and a subject sequence. A subject sequence typically has a length that is from about 80 percent to 250 percent of the length of the query sequence, e.g., 82, 85, 87, 89, 90, 93, 95, 97, 99, 100, 105, 110, 115, or 120, 130, 140, 150, 160, 170, 180, 190, 200, 210, 220, 230, 240, or 250 percent of the length of the query sequence. A query nucleic acid or amino acid sequence is aligned to one or more subject nucleic acid or amino acid sequences using the computer program ClustalW (version 1.83, default parameters), which allows alignments of nucleic acid or protein sequences to be carried out across their entire length (global alignment). Chenna et al. (2003) *Nucleic Acids Res.* 31(13): 3497-500.

ClustalW calculates the best match between a query and one or more subject sequences, and aligns them so that identities, similarities and differences can be determined. Gaps of one or more residues can be inserted into a query sequence, a subject sequence, or both, to maximize sequence alignments. For fast pairwise alignment of nucleic acid sequences, the following default parameters are used: word size: 2; window size: 4; scoring method: percentage; number of top diagonals: 4; and gap penalty: 5. For an alignment of multiple nucleic acid sequences, the following parameters are used: gap opening penalty: 10.0; gap extension penalty: 5.0; and weight transitions: yes. For fast pairwise alignment of protein sequences, the following parameters are used: word size: 1; window size: 5; scoring method: percentage; number of top diagonals: 5; gap penalty: 3. For multiple alignment of protein sequences, the following parameters are used: weight matrix: blosum; gap opening penalty: 10.0; gap extension penalty: 0.05; hydrophilic gaps: on; hydrophilic residues: Gly, Pro, Ser, Asn, Asp, Gln, Glu, Arg, and Lys; residue-specific gap penalties: on. The output is a sequence alignment that reflects the relationship between sequences. ClustalW can be run, for example, at the Baylor College of Medicine Search Launcher website and at the European Bioinformatics Institute website on the World Wide Web.

To determine a percent identity for polypeptide or nucleic acid sequences between a query and a subject sequence, the sequences are aligned using Clustal W and the number of identical matches in the alignment is divided by the query length, and the result is multiplied by 100. The output is the percent identity of the subject sequence with respect to the query sequence. It is noted that the percent identity value can be rounded to the nearest tenth. For example, 78.11, 78.12, 78.13, and 78.14 are rounded down to 78.1, while 78.15, 78.16, 78.17, 78.18, and 78.19 are rounded up to 78.2.

Photosynthetic efficiency: photosynthetic efficiency, or electron transport via photosystem II, is estimated by the relationship between Fm, the maximum fluorescence signal and the variable fluorescence, Fv. Here, a reduction in the optimum quantum yield (Fv/Fm) indicates stress and can be used to monitor the performance of transgenic plants compared to non-transgenic plants under salt stress conditions.

Regulatory Regions: The term "regulatory region" refers to nucleotide sequences that, when operably linked to a sequence, influence transcription initiation or translation initiation or transcription termination of said sequence and the rate of said processes, and/or stability and/or mobility of a transcription or translation product. As used herein, the term "operably linked" refers to positioning of a regulatory region and said sequence to enable said influence. Regulatory regions include, without limitation, promoter sequences, enhancer sequences, response elements, protein recognition sites, inducible elements, protein binding sequences, 5' and 3' untranslated regions (UTRs), transcriptional start sites, termination sequences, polyadenylation sequences, and introns. Regulatory regions can be classified in two categories, promoters and other regulatory regions.

Salt tolerance: Plant species vary in their capacity to tolerate salinity. "Salinity" can be defined as the set of environmental conditions under which a plant will begin to suffer the effects of elevated salt concentration, such as ion imbalance, decreased stomatal conductance, decreased photosynthesis, decreased growth rate, increased cell death, loss of turgor (wilting), or ovule abortion. For these reasons, plants experiencing salinity stress typically exhibit a significant reduction in biomass and/or yield.

Elevated salinity may be caused by natural, geological processes and by human activities, such as irrigation. Since plant species vary in their capacity to tolerate water deficit, the precise environmental salt conditions that cause stress cannot be generalized. However, under saline conditions, salt tolerant plants produce higher biomass, yield and survivorship than plants that are not salt tolerant. Differences in physical appearance, recovery and yield can be quantified and statistically analyzed using well known measurement and analysis methods.

Seedling area: The total leaf area of a young plant about 2 weeks old.

Seedling vigor: As used herein, "seedling vigor" refers to the plant characteristic whereby the plant emerges from soil faster, has an increased germination rate (i.e., germinates faster), has faster and larger seedling growth and/or germinates faster under salt conditions as compared to the wild-type or control under similar conditions. Seedling vigor has often been defined to comprise the seed properties that determine "the potential for rapid, uniform emergence and development of normal seedlings under a wide range of field conditions".

Stringency: "Stringency," as used herein is a function of nucleic acid molecule probe length, nucleic acid molecule probe composition (G+C content), salt concentration, organic solvent concentration and temperature of hybridization and/or wash conditions. Stringency is typically measured by the parameter $T_m$, which is the temperature at which 50% of the complementary nucleic acid molecules in the hybridization assay are hybridized, in terms of a temperature differential from $T_m$. High stringency conditions are those providing a condition of $T_m-5°$ C. to $T_m-10°$ C. Medium or moderate stringency conditions are those providing $T_m-20°$ C. to $T_m-29°$ C. Low stringency conditions are those providing a condition of $T_m-40°$ C. to $T_m-48°$ C. The relationship between hybridization conditions and $T_m$ (in °C.) is expressed in the mathematical equation:

$$T_m=81.5-16.6(\log_{10}[Na^+])+0.41(\% \ G+C)-(600/N) \quad (I)$$

where N is the number of nucleotides of the nucleic acid molecule probe. This equation works well for probes 14 to 70 nucleotides in length that are identical to the target sequence. The equation below, for $T_m$ of DNA-DNA hybrids, is useful for probes having lengths in the range of 50 to greater than 500 nucleotides, and for conditions that include an organic solvent (formamide):

$$T_m=81.5+16.6 \log\{[Na^+]/(1+0.7[Na^+])\}+0.41(\% \ G+C)-500/L \ 0.63(\% \ \text{formamide}) \quad (II)$$

where L represents the number of nucleotides in the probe in the hybrid (Bonner et al. (1973) *J. Mol. Biol.* 81:123). The $T_m$ of Equation II is affected by the nature of the hybrid: for DNA-RNA hybrids, $T_m$ is 10-15° C. higher than calculated; for RNA-RNA hybrids, $T_m$ is 20-25° C. higher. Because the $T_m$ decreases about 1° C. for each 1% decrease in homology when a long probe is used (Frischauf et al. (1983) *J. Mol Biol,* 170: 827-842), stringency conditions can be adjusted to favor detection of identical genes or related family members.

Equation II is derived assuming the reaction is at equilibrium. Therefore, hybridizations according to the present invention are most preferably performed under conditions of probe excess and allowing sufficient time to achieve equilibrium. The time required to reach equilibrium can be shortened by using a hybridization buffer that includes a hybridization accelerator such as dextran sulfate or another high volume polymer.

Stringency can be controlled during the hybridization reaction, or after hybridization has occurred, by altering the salt and temperature conditions of the wash solutions. The formulas shown above are equally valid when used to compute the stringency of a wash solution. Preferred wash solution stringencies lie within the ranges stated above; high stringency is 5-8° C. below $T_m$, medium or moderate stringency is 26-29° C. below $T_m$ and low stringency is 45-48° C. below $T_m$.

For example, the hybridization step may be performed in aqueous hybridization solution at a temperature between 63° C. and 70° C., more preferably at a temperature between 65° C. and 68° C. and most preferably at a temperature of 65° C. Alternatively, the high stringency hybridization step may be performed in formamide hybridization solution at a temperature between 40° C. and 46° C., at a temperature between 41° C. and 44° C. and most preferably at a temperature of 42° C.

A wash step follows hybridization, and an initial wash is performed with wash solution 1 at 25° C. or 37° C. Following the initial wash, additional washes are performed with wash solution 1 at a temperature between 63° C. and 70° C., more preferably at a temperature between 65° C. and 68° C. and most preferably at a temperature of 65° C. The number of additional wash steps can be 1, 2, 3, 4, 5 or more. The time of both the initial and additional wash steps may be 5 minutes, 10 minutes, 15 minutes, 20 minutes, 25 minutes, 30 minutes, 45 minutes, 1 hour, 1.5 hours, 2 hours or more.

Set forth below are the composition of the hybridization and wash solutions and their components. A person of ordinary skill in the art will recognize that these solutions are typical and exemplary of high stringency hybridization solutions.

| | |
|---|---|
| Aqueous Hybridization Solution: | 6X SSC or 6X SSPE<br>0.05% Blotto or 5X Denhardt's Reagent<br>100 μg/ml denatured salmon sperm DNA<br>0.05% SDS |
| Formamide Hybridization Solution: | 50% Formamide<br>6X SSC or 6X SSPE<br>0.05% Blotto or 5X Denhardt's Reagent<br>100 μg/ml denatured salmon sperm DNA<br>0.05% SDS |
| Wash Solution 1: | 2X SSC or SSPE<br>0.1% SDS |
| Wash Solution 2: | 0.1X SSC or SSPE<br>0.5% SDS |
| 20X SSC: | 175.3 g NaCl<br>88.2 g Sodium Citrate<br>Bring to 800 ml with $H_2O$<br>Adjust to pH 7 with 10 n NaOH<br>Bring to 1 L with $H_2O$ |
| 20X SSPE: | 175.3 g NaCl<br>27.6 g $NaH_2PO_4$<br>Bring to 800 ml with $H_2O \cdot H_2O$<br>7.4 g EDTA<br>Adjust to pH 7.4 with 10 n NaOH<br>Bring to 1 L with $H_2O$ |
| 1X BLOTTO: | 5% Non-fat dry milk<br>0.02% Sodium azide |
| 50X Denhardts's Reagent: | 5 g Ficoll<br>5 g Polyvinylpyrrolidone<br>5 g BSA<br>Adjust to 500 ml with $H_2O$ |

Superpool: As used in the context of the current invention, a "superpool" contains an equal amount of seed from 500 different events, representing 100 distinct exogenous nucleotide sequences. An event is a plant carrying a unique insertion of a distinct exogenous sequence which misexpresses that sequence. Transformation of a single polynucleotide sequence can result in multiple events because the sequence can insert in a different part of the genome with each transformation.

$T_0$: The term "$T_0$" refers to the whole plant, explant or callus tissue, inoculated with the transformation medium.

$T_1$: The term $T_1$ refers to either the progeny of the $T_0$ plant, in the case of whole-plant transformation, or the regenerated seedling in the case of explant or callous tissue transformation.

$T_2$: The term $T_2$ refers to the progeny of the $T_1$ plant. $T_2$ progeny are the result of self-fertilization or cross-pollination of a $T_1$ plant.

$T_3$: The term $T_3$ refers to second generation progeny of the plant that is the direct result of a transformation experiment. $T_3$ progeny are the result of self-fertilization or cross-pollination of a $T_2$ plant.

$T_4$: As used in the current application, the term $T_4$ refers to third generation progeny of the plant that is the direct result of a transformation experiment. $T_4$ progeny are the result of self-fertilization or cross pollination of a $T_3$ plant.

Transformation: Examples of means by which this can be accomplished are described below and include *Agrobacterium*-mediated transformation (of dicots (Needleman and Wunsch (1970) *J. Mol. Biol.* 48:443; Pearson and Lipman (1988) *Proc. Natl. Acad. Sci.* (*USA*) 85: 2444), of monocots (Yamauchi et al. (1996) *Plant Mol Biol.* 30:321-9; Xu et al. (1995) *Plant Mol. Biol.* 27:237; Yamamoto et al. (1991) *Plant Cell* 3:371), and biolistic methods (P. Tijessen, "Hybridization with Nucleic Acid Probes" In Laboratory Techniques in Biochemistry and Molecular Biology, P. C. vand der Vliet, ed., c. 1993 by Elsevier, Amsterdam), electroporation, in planta techniques and the like. Such a plant containing the exogenous nucleic acid is referred to here as a $T_0$ for the primary transgenic plant and $T_1$ for the first generation.

3. Important Characteristics of the Polynucleotides and Polypeptides of the Invention The nucleic acid molecules and polypeptides of the present invention are of interest because when the nucleic acid molecules are mis-expressed (i.e., when expressed at a non-natural location or in an increased or decreased amount relative to wild-type) they produce plants that exhibit improved salt tolerance as compared to wild-type plants, as evidenced by the results of various experiments disclosed below. In particular, plants transformed with at least one of the nucleic acid molecules and polypeptides of the present invention have increased salt growth index values as compared to wild-type plants. For example, plants transformed with the sequences of the present invention can exhibit increases in SGI values of at least 25%, at least 50%, at least 75%, at least 100%, at least 200%, at least 300%, at least 400%, or even at least 500%. This trait can be used to exploit or maximize plant products. For example, the nucleic acid molecules and polypeptides of the present invention are used to increase the expression of genes that cause the plant to have improved biomass, growth rate and/or seedling vigor in saline conditions.

Because the disclosed sequences and methods increase vegetative growth and growth rate in saline conditions, the disclosed methods can be used to enhance plant growth in plants irrigated with saline water and/or grown in saline soil. For example, plants of the invention show, under saline conditions, increased photosynthetic efficiency and increased seedling area as compared to a plant of the same species that is not genetically modified for substantial vegetative growth. Examples of increases in biomass production include increases of at least 5%, at least 20%, or even at least 50%, when compared to an amount of biomass production by a wild-type plant of the same species under identical conditions.

Seed or seedling vigor is an important characteristic that can greatly influence successful growth of a plant, such as crop plants. Adverse environmental conditions, such as saline conditions, can affect a plant growth cycle, germination of seeds and seedling vigor (i.e. vitality and strength under such conditions can differentiate between successful and failed crop growth). Seedling vigor has often been defined to comprise the seed properties that determine "the potential for rapid, uniform emergence and development of normal seedlings under a wide range of field conditions". Hence, it would be advantageous to develop plant seeds with increased vigor, particularly in elevated salinity.

For example, increased seedling vigor would be advantageous for cereal plants such as rice, maize, wheat, etc. production. For these crops, germination and growth can often be slowed or stopped by salination. Genes associated with increased seed vigor and/or salination tolerance have therefore been sought for producing improved crop varieties. (Walia et al. (2005) *Plant Physiology* 139:822-835).

4. The Polypeptides/Polynucleotides of the Invention

The polynucleotides of the present invention and the proteins expressed via translation of these polynucleotides are set forth in the Sequence Listing, specifically SEQ ID NOs. 79-253 and 269-315. The Sequence Listing also consists of functionally comparable proteins. Polypeptides comprised of a sequence belonging to the consensus sequence families shown in FIGS. 1 to 9 as delineated by HMMs can be utilized for the purposes of the invention, namely to make transgenic plants with improved biomass, growth rate and/or seedling vigor in saline conditions.

5. Use of the Polypeptides to Make Transgenic Plants

To use the sequences of the present invention or a combination of them or parts and/or mutants and/or fusions and/or variants of them, recombinant DNA constructs are prepared that comprise the polynucleotide sequences of the invention inserted into a vector and that are suitable for transformation of plant cells. The construct can be made using standard recombinant DNA techniques (see, Sambrook et al., Molecular Cloning: A Laboratory Manual, Second Edition, Cold Spring Harbor Laboratory Press, 1989, New York.) and can be introduced into the plant species of interest by, for example, *Agrobacterium*-mediated transformation, or by other means of transformation, for example, as disclosed below.

The vector backbone may be any of those typically used in the field such as plasmids, viruses, artificial chromosomes, BACs, YACs, PACs and vectors such as, for instance, bacteria-yeast shuttle vectors, lambda phage vectors, T-DNA fusion vectors and plasmid vectors (see, Shizuya et al. (1992) *Proc. Natl. Acad. Sci. USA* 89: 8794-8797; Hamilton et al. (1996) *Proc. Natl. Acad. Sci. USA* 93: 9975-9979; Burke et al. (1987) *Science* 236:806-812; Sternberg N. et al. (1990) *Proc Natl Acad Sci USA*. 87:103-7; Bradshaw et al. (1995) *Nucl Acids Res* 23: 4850-4856; Frischauf et al. (1983) *J. Mol Biol* 170: 827-842; Huynh et al., Glover N M (ed) DNA Cloning: A practical Approach, Vol. 1 Oxford: IRL Press (1985); Walden et al. (1990) *Mol Cell Biol* 1: 175-194).

Typically, the construct comprises a vector containing a nucleic acid molecule of the present invention with any desired transcriptional and/or translational regulatory sequences such as, for example, promoters, UTRs, and 3' end termination sequences. Vectors may also include, for example, origins of replication, scaffold attachment regions (SARs), markers, homologous sequences, and introns. The vector may also comprise a marker gene that confers a selectable phenotype on plant cells. The marker may preferably encode a biocide resistance trait, particularly antibiotic resistance, such as resistance to, for example, kanamycin, bleomycin, or hygromycin, or herbicide resistance, such as resistance to, for example, glyphosate, chlorosulfuron or phosphinotricin.

It will be understood that more than one regulatory region may be present in a recombinant polynucleotide, e.g., introns, enhancers, upstream activation regions, transcription terminators, and inducible elements. Thus, more than one regulatory region can be operably linked to said sequence.

To "operably link" a promoter sequence to a sequence, the translation initiation site of the translational reading frame of said sequence is typically positioned between one and about fifty nucleotides downstream of the promoter. A promoter can, however, be positioned as much as about 5,000 nucleotides upstream of the translation initiation site, or about 2,000 nucleotides upstream of the transcription start site. A promoter typically comprises at least a core (basal) promoter. A promoter also may include at least one control element, such as an enhancer sequence, an upstream element or an upstream activation region (UAR). For example, a suitable enhancer is a cis-regulatory element (−212 to −154) from the upstream region of the octopine synthase (ocs) gene. Fromm et al. (1989) *Plant Cell* 1:977-984.

Some suitable promoters initiate transcription only, or predominantly, in certain cell types. For example, a promoter that is active predominantly in a reproductive tissue (e.g., fruit, ovule, pollen, pistils, female gametophyte, egg cell, central cell, nucellus, suspensor, synergid cell, flowers, embryonic tissue, embryo sac, embryo, zygote, endosperm, integument, or seed coat) can be used. Thus, as used herein a cell type- or tissue-preferential promoter is one that drives expression preferentially in the target tissue, but may also lead to some expression in other cell types or tissues as well. Methods for identifying and characterizing promoter regions in plant genomic DNA include, for example, those described in the following references: Jordano, et al. (1989) *Plant Cell* 1:855-866; Bustos et al. (1989) *Plant Cell* 1:839-854; Green et al. (1988) *EMBO J*. 7: 4035-4044; Meier et al. (1991) *Plant Cell* 3: 309-316; and Zhang et al. (1996) *Plant Physiology* 110: 1069-1079.

Examples of various classes of promoters are described below. Some of the promoters indicated below are described in more detail in U.S. Patent Application Ser. Nos. 60/505, 689; 60/518,075; 60/544,771; 60/558,869; 60/583,691; 60/619,181; 60/637,140; 10/950,321; 10/957,569; 11/058, 689; 11/172,703; 11/208,308; and PCT/US05/23639. It will be appreciated that a promoter may meet criteria for one classification based on its activity in one plant species, and yet meet criteria for a different classification based on its activity in another plant species.

Other Regulatory Regions: A 5' untranslated region (UTR) can be included in nucleic acid constructs described herein. A 5' UTR is transcribed, but is not translated, and lies between the start site of the transcript and the translation initiation codon and may include the +1 nucleotide. A 3' UTR can be positioned between the translation termination codon and the end of the transcript. UTRs can have particular functions such as increasing mRNA stability or attenuating translation. Examples of 3' UTRs include, but are not limited to, polyadenylation signals and transcription termination sequences, e.g., a nopaline synthase termination sequence.

Various promoters can be used to drive expression of the polynucleotides of the present invention. Nucleotide sequences of such promoters are set forth in SEQ ID NOS:

1-78. Some of them can be broadly expressing promoters, others may be more tissue preferential.

A promoter can be said to be "broadly expressing" when it promotes transcription in many, but not necessarily all, plant tissues or plant cells. For example, a broadly expressing promoter can promote transcription of an operably linked sequence in one or more of the shoot, shoot tip (apex), and leaves, but weakly or not at all in tissues such as roots or stems. As another example, a broadly expressing promoter can promote transcription of an operably linked sequence in one or more of the stem, shoot, shoot tip (apex), and leaves, but can promote transcription weakly or not at all in tissues such as reproductive tissues of flowers and developing seeds. Non-limiting examples of broadly expressing promoters that can be included in the nucleic acid constructs provided herein include the p326 (SEQ ID NO: 76), YP0144 (SEQ ID NO: 55), YP0190 (SEQ ID NO: 59), p13879 (SEQ ID NO: 75), YP0050 (SEQ ID NO: 35), p32449 (SEQ ID NO: 77), 21876 (SEQ ID NO: 1), YP0158 (SEQ ID NO: 57), YP0214 (SEQ ID NO: 61), YP0380 (SEQ ID NO: 70), PT0848 (SEQ ID NO: 26), and PT0633 (SEQ ID NO: 7). Additional examples include the cauliflower mosaic virus (CaMV) 35S promoter, the mannopine synthase (MAS) promoter, the 1' or 2' promoters derived from T-DNA of *Agrobacterium tumefaciens*, the figwort mosaic virus 34S promoter, actin promoters such as the rice actin promoter, and ubiquitin promoters such as the maize ubiquitin-1 promoter. In some cases, the CaMV 35S promoter is excluded from the category of broadly expressing promoters.

Root-active promoters drive transcription in root tissue, e.g., root endodermis, root epidermis, or root vascular tissues. In some embodiments, root-active promoters are root-preferential promoters, i.e., drive transcription only or predominantly in root tissue. Root-preferential promoters include the YP0128 (SEQ ID NO: 52), YP0275 (SEQ ID NO: 63), PT0625 (SEQ ID NO: 6), PT0660 (SEQ ID NO: 9), PT0683 (SEQ ID NO: 14), and PT0758 (SEQ ID NO: 22). Other root-preferential promoters include the PT0613 (SEQ ID NO: 5), PT0672 (SEQ ID NO: 11), PT0688 (SEQ ID NO: 15), and PT0837 (SEQ ID NO: 24), which drive transcription primarily in root tissue and to a lesser extent in ovules and/or seeds. Other examples of root-preferential promoters include the root-specific subdomains of the CaMV 35S promoter (Lam et al. (1989) *Proc. Natl. Acad. Sci. USA* 86:7890-7894), root cell specific promoters reported by Conkling et al. (1990) *Plant Physiol.* 93:1203-1211 and the tobacco RD2 gene promoter.

In some embodiments, promoters that drive transcription in maturing endosperm can be useful. Transcription from a maturing endosperm promoter typically begins after fertilization and occurs primarily in endosperm tissue during seed development and is typically highest during the cellularization phase. Most suitable are promoters that are active predominantly in maturing endosperm, although promoters that are also active in other tissues can sometimes be used. Non-limiting examples of maturing endosperm promoters that can be included in the nucleic acid constructs provided herein include the napin promoter, the Arcelin-5 promoter, the phaseolin gene promoter (Bustos et al. (1989) *Plant Cell* 1(9):839-853), the soybean trypsin inhibitor promoter (Riggs et al. (1989) *Plant Cell* 1(6):609-621), the ACP promoter (Baerson et al. (1993) *Plant Mol Biol*, 22(2):255-267), the stearoyl-ACP desaturase gene (Slocombe et al. (1994) *Plant Physiol* 104(4):167-176), the soybean α' subunit of β-conglycinin promoter (Chen et al. (1986) *Proc Natl Acad Sci USA* 83:8560-8564), the oleosin promoter (Hong et al. (1997) *Plant Mol Biol* 34(3):549-555), and zein promoters, such as the 15 kD zein promoter, the 16 kD zein promoter, 19 kD zein promoter, 22 kD zein promoter and 27 kD zein promoter. Also suitable are the Osgt-1 promoter from the rice glutelin-1 gene (Zheng et al. (1993) *Mol. Cell Biol.* 13:5829-5842), the beta-amylase gene promoter, and the barley hordein gene promoter. Other maturing endosperm promoters include the YP0092 (SEQ ID NO: 38), PT0676 (SEQ ID NO: 12), and PT0708 (SEQ ID NO: 17).

Promoters that drive transcription in ovary tissues such as the ovule wall and mesocarp can also be useful, e.g., a polygalacturonidase promoter, the banana TRX promoter, and the melon actin promoter. Other such promoters that drive gene expression preferentially in ovules are YP0007 (SEQ ID NO: 30), YP0111 (SEQ ID NO: 46), YP0092 (SEQ ID NO: 38), YP0103 (SEQ ID NO: 43), YP0028 (SEQ ID NO: 33), YP0121 (SEQ ID NO: 51), YP0008 (SEQ ID NO: 31), YP0039 (SEQ ID NO: 34), YP0115 (SEQ ID NO: 47), YP0119 (SEQ ID NO: 49), YP0120 (SEQ ID NO: 50) and YP0374 (SEQ ID NO: 68).

In some other embodiments of the present invention, embryo sac/early endosperm promoters can be used in order drive transcription of the sequence of interest in polar nuclei and/or the central cell, or in precursors to polar nuclei, but not in egg cells or precursors to egg cells. Most suitable are promoters that drive expression only or predominantly in polar nuclei or precursors thereto and/or the central cell. A pattern of transcription that extends from polar nuclei into early endosperm development can also be found with embryo sac/early endosperm-preferential promoters, although transcription typically decreases significantly in later endosperm development during and after the cellularization phase. Expression in the zygote or developing embryo typically is not present with embryo sac/early endosperm promoters.

Promoters that may be suitable include those derived from the following genes: *Arabidopsis* viviparous-1 (see, GenBank No. U93215); *Arabidopsis* atmycl (see Urao (1996) *Plant Mol. Biol.*, 32:571-57; Conceicao (1994) *Plant*, 5:493-505); *Arabidopsis* FIE (GenBank No. AF129516); *Arabidopsis* MEA; *Arabidopsis* FIS2 (GenBank No. AF096096); and FIE 1.1 (U.S. Pat. No. 6,906,244). Other promoters that may be suitable include those derived from the following genes: maize MAC1 (see, Sheridan (1996) *Genetics*, 142:1009-1020); maize Cat3 (see, GenBank No. L05934; Abler (1993) *Plant Mol. Biol.*, 22:10131-1038). Other promoters include the following *Arabidopsis* promoters: YP0039 (SEQ ID NO: 34), YP0101 (SEQ ID NO: 41), YP0102 (SEQ ID NO: 42), YP0110 (SEQ ID NO: 45), YP0117 (SEQ ID NO: 48), YP0119 (SEQ ID NO: 49), YP0137 (SEQ ID NO: 53), DME, YP0285 (SEQ ID NO: 64), and YP0212 (SEQ ID NO: 60). Other promoters that may be useful include the following rice promoters: p530c10, pOsFIE2-2, pOsMEA, pOsYp102, and pOsYp285.

Promoters that preferentially drive transcription in zygotic cells following fertilization can provide embryo-preferential expression and may be useful for the present invention. Most suitable are promoters that preferentially drive transcription in early stage embryos prior to the heart stage, but expression in late stage and maturing embryos is also suitable. Embryo-preferential promoters include the barley lipid transfer protein (Ltp1) promoter (*Plant Cell Rep* (2001) 20:647-654, YP0097 (SEQ ID NO: 40), YP0107 (SEQ ID NO: 44), YP0088 (SEQ ID NO: 37), YP0143 (SEQ ID NO: 54), YP0156 (SEQ ID NO: 56), PT0650 (SEQ ID NO: 8), PT0695 (SEQ ID NO: 16), PT0723 (SEQ ID NO: 19), PT0838 (SEQ ID NO: 25), PT0879 (SEQ ID NO: 28) and PT0740 (SEQ ID NO: 20).

Promoters active in photosynthetic tissue in order to drive transcription in green tissues such as leaves and stems are of particular interest for the present invention. Most suitable are promoters that drive expression only or predominantly such tissues. Examples of such promoters include the ribulose-1, 5-bisphosphate carboxylase (RbcS) promoters such as the RbcS promoter from eastern larch (*Larix laricina*), the pine cab6 promoter (Yamamoto et al. (1994) *Plant Cell Physiol.* 35:773-778), the Cab-1 gene promoter from wheat (Fejes et al. (1990) *Plant Mol. Biol.* 15:921-932), the CAB-1 promoter from spinach (Lubberstedt et al. (1994) *Plant Physiol.* 104: 997-1006), the cab1R promoter from rice (Luan et al. (1992) *Plant Cell* 4:971-981), the pyruvate orthophosphate dikinase (PPDK) promoter from corn (Matsuoka et al. (1993) *Proc Natl Acad. Sci USA* 90:9586-9590), the tobacco Lhcb1*2 promoter (Cerdan et al. (1997) *Plant Mol. Biol.* 33:245-255), the *Arabidopsis thaliana* SUC2 sucrose-H+ symporter promoter (Truernit et al. (1995) *Planta* 196:564-570), and thylakoid membrane protein promoters from spinach (psaD, psaF, psaE, PC, FNR, atpC, atpD, cab, rbcS. Other promoters that drive transcription in stems, leafs and green tissue are PT0535 (SEQ ID NO: 3), PT0668 (SEQ ID NO: 2), PT0886 (SEQ ID NO: 29), PR0924 (SEQ ID NO: 265), YP0144 (SEQ ID NO: 55), YP0380 (SEQ ID NO: 70) and PT0585 (SEQ ID NO: 4).

In some other embodiments of the present invention, inducible promoters may be desired. Inducible promoters drive transcription in response to external stimuli such as chemical agents or environmental stimuli. For example, inducible promoters can confer transcription in response to hormones such as giberellic acid or ethylene, or in response to light or drought. Examples of drought inducible promoters are YP0380 (SEQ ID NO: 70), PT0848 (SEQ ID NO: 26), YP0381 (SEQ ID NO: 71), YP0337 (SEQ ID NO: 66), PT0633 (SEQ ID NO: 7), YP0374 (SEQ ID NO: 68), PT0710 (SEQ ID NO: 18), YP0356 (SEQ ID NO: 67), YP0385 (SEQ ID NO: 73), YP0396 (SEQ ID NO: 74), YP0384 (SEQ ID NO: 72), PT0688 (SEQ ID NO: 15), YP0286 (SEQ ID NO: 65), YP0377 (SEQ ID NO: 69), and PD1367 (SEQ ID NO: 78). Examples of promoters induced by nitrogen are PT0863 (SEQ ID NO: 27), PT0829 (SEQ ID NO: 23), PT0665 (SEQ ID NO: 10) and PT0886 (SEQ ID NO: 29). An example of a promoter induced by salt is rd29A (Kasuga et al. (1999) *Nature Biotech* 17: 287-291).

Other Promoters: Other classes of promoters include, but are not limited to, leaf-preferential, stem/shoot-preferential, callus-preferential, guard cell-preferential, such as PT0678 (SEQ ID NO: 13), and senescence-preferential promoters. Promoters designated YP0086 (SEQ ID NO: 36), YP0188 (SEQ ID NO: 58), YP0263 (SEQ ID NO: 62), PT0758 (SEQ ID NO: 22), PT0743 (SEQ ID NO: 21), PT0829 (SEQ ID NO: 23), YP0119 (SEQ ID NO: 49), and YP0096 (SEQ ID NO: 39), as described in the above-referenced patent applications, may also be useful.

Alternatively, misexpression can be accomplished using a two component system, whereby the first component consists of a transgenic plant comprising a transcriptional activator operatively linked to a promoter and the second component consists of a transgenic plant that comprise a nucleic acid molecule of the invention operatively linked to the target-binding sequence/region of the transcriptional activator. The two transgenic plants are crossed and the nucleic acid molecule of the invention is expressed in the progeny of the plant. In another alternative embodiment of the present invention, the misexpression can be accomplished by having the sequences of the two component system transformed in one transgenic plant line.

Another alternative consists in inhibiting expression of a biomass or vigor-modulating polypeptide in a plant species of interest under saline conditions. The term "expression" refers to the process of converting genetic information encoded in a polynucleotide into RNA through transcription of the polynucleotide (i.e., via the enzymatic action of an RNA polymerase), and into protein through translation of mRNA. "Up-regulation" or "activation" refers to regulation that increases the production of expression products relative to basal or native states, while "down-regulation" or "repression" refers to regulation that decreases production relative to basal or native states.

A number of nucleic-acid based methods, including antisense RNA, ribozyme directed RNA cleavage, and interfering RNA (RNAi) can be used to inhibit protein expression in plants. Antisense technology is one well-known method. In this method, a nucleic acid segment from the endogenous gene is cloned and operably linked to a promoter so that the antisense strand of RNA is transcribed. The recombinant vector is then transformed into plants, as described above, and the antisense strand of RNA is produced. The nucleic acid segment need not be the entire sequence of the endogenous gene to be repressed, but typically will be substantially identical to at least a portion of the endogenous gene to be repressed. Generally, higher homology can be used to compensate for the use of a shorter sequence. Typically, a sequence of at least 30 nucleotides is used (e.g., at least 40, 50, 80, 100, 200, 500 nucleotides or more).

Thus, for example, an isolated nucleic acid provided herein can be an antisense nucleic acid to one of the aforementioned nucleic acids encoding a polypeptide modulates biomass under saline conditions. A nucleic acid that decreases the level of a transcription or translation product of a gene encoding a biomass-modulating polypeptide is transcribed into an antisense nucleic acid similar or identical to the sense coding sequence of the biomass- or growth rate-modulating polypeptide. Alternatively, the transcription product of an isolated nucleic acid can be similar or identical to the sense coding sequence of a biomass growth rate-modulating polypeptide, but is an RNA that is unpolyadenylated, lacks a 5' cap structure, or contains an unsplicable intron.

In another method, a nucleic acid can be transcribed into a ribozyme, or catalytic RNA, that affects expression of an mRNA. (See, U.S. Pat. No. 6,423,885). Ribozymes can be designed to specifically pair with virtually any target RNA and cleave the phosphodiester backbone at a specific location, thereby functionally inactivating the target RNA. Heterologous nucleic acids can encode ribozymes designed to cleave particular mRNA transcripts, thus preventing expression of a polypeptide. Hammerhead ribozymes are useful for destroying particular mRNAs, although various ribozymes that cleave mRNA at site-specific recognition sequences can be used. Hammerhead ribozymes cleave mRNAs at locations dictated by flanking regions that form complementary base pairs with the target mRNA. The sole requirement is that the target RNA contains a 5'-UG-3' nucleotide sequence. The construction and production of hammerhead ribozymes is known in the art. See, for example, U.S. Pat. No. 5,254,678 and WO 02/46449 and references cited therein. Hammerhead ribozyme sequences can be embedded in a stable RNA such as a transfer RNA (tRNA) to increase cleavage efficiency in vivo. Perriman, et al. (1995) *Proc. Natl. Acad. Sci. USA*, 92(13):6175-6179; de Feyter and Gaudron, Methods in Molecular Biology, Vol. 74, Chapter 43, "Expressing Ribozymes in Plants", Edited by Turner, P. C, Humana Press Inc., Totowa, N.J. RNA endoribonucleases such as the one that occurs naturally in *Tetrahymena thermophila*, and which have been described extensively by Cech and collaborators can be useful. See, for example, U.S. Pat. No. 4,987,071.

Methods based on RNA interference (RNAi) can be used. RNA interference is a cellular mechanism to regulate the expression of genes and the replication of viruses. This mechanism is thought to be mediated by double-stranded small interfering RNA molecules. A cell responds to such a double-stranded RNA by destroying endogenous mRNA having the same sequence as the double-stranded RNA. Methods for designing and preparing interfering RNAs are known to those of skill in the art; see, e.g., WO 99/32619 and WO 01/75164. For example, a construct can be prepared that includes a sequence that is transcribed into an interfering RNA. Such an RNA can be one that can anneal to itself, e.g., a double stranded RNA having a stem-loop structure. One strand of the stem portion of a double stranded RNA comprises a sequence that is similar or identical to the sense coding sequence of the polypeptide of interest, and that is from about 10 nucleotides to about 2,500 nucleotides in length. The length of the sequence that is similar or identical to the sense coding sequence can be from 10 nucleotides to 500 nucleotides, from 15 nucleotides to 300 nucleotides, from 20 nucleotides to 100 nucleotides, or from 25 nucleotides to 100 nucleotides. The other strand of the stem portion of a double stranded RNA comprises an antisense sequence of the biomass-modulating polypeptide of interest, and can have a length that is shorter, the same as, or longer than the corresponding length of the sense sequence. The loop portion of a double stranded RNA can be from 10 nucleotides to 5,000 nucleotides, e.g., from 15 nucleotides to 1,000 nucleotides, from 20 nucleotides to 500 nucleotides, or from 25 nucleotides to 200 nucleotides. The loop portion of the RNA can include an intron. See, e.g., WO 99/53050.

Transcriptional silencing of the target gene can also be achieved via the promoter through expression of an RNAi construct. This results in the synthesis of double stranded RNA molecules of which the nucleotides sequence is identical to a part of the promoter region of the target gene.

Another alternative method for suppression of the target gene may be achieved through a methodology generally referred to as Virus Induced Gene Silencing or VIGS (Ratcliff et al (2001) Plant J. 25, 237-245). Here, effective and specific gene silencing is achieved by infection of a plant with a plant virus carrying an insert which is homologous to the target gene. The advantage of the VIGS system is that there is no need to develop a plant transformation protocol for the plant species in which the target gene resides.

In all of these silencing methods, the silencing construct (antisense RNA, co-suppression, RNAi or hairpin construct or VIGs vector) preferably contains a DNA fragment that is identical to the target sequence (gene or promoter) that needs to be silenced. The percentage of identity may, however, range between 50-100%, preferably between 60-100%, more preferably between 70-100%, even more preferably between 80-100% and most preferably between 90-100%.

In some nucleic-acid based methods for inhibition of gene expression in plants, a suitable nucleic acid can be a nucleic acid analog. Nucleic acid analogs can be modified at the base moiety, sugar moiety, or phosphate backbone to improve, for example, stability, hybridization, or solubility of the nucleic acid. Modifications at the base moiety include deoxyuridine for deoxythymidine, and 5-methyl-2'-deoxycytidine and 5-bromo-2'-deoxycytidine for deoxycytidine. Modifications of the sugar moiety include modification of the 2' hydroxyl of the ribose sugar to form 2'-O-methyl or 2'-O-allyl sugars. The deoxyribose phosphate backbone can be modified to produce morpholino nucleic acids, in which each base moiety is linked to a six-membered morpholino ring, or peptide nucleic acids, in which the deoxyphosphate backbone is replaced by a pseudopeptide backbone and the four bases are retained. See, for example, Summerton and Weller, 1997, *Antisense Nucleic Acid Drug Dev.*, 7:187-195; Hyrup et al., 1996, *Bioorgan. Med. Chem.*, 4: 5-23. In addition, the deoxyphosphate backbone can be replaced with, for example, a phosphorothioate or phosphorodithioate backbone, a phosphoroamidite, or an alkyl phosphotriester backbone.

Transformation

Nucleic acid molecules of the present invention may be introduced into the genome or the cell of the appropriate host plant by a variety of techniques. These techniques, able to transform a wide variety of higher plant species, are well known and described in the technical and scientific literature (see, e.g., Weising et al. (1988) *Ann. Rev. Genet.*, 22:421 and Christou (1995) *Euphytica*, 85:13-27).

A variety of techniques known in the art are available for the introduction of DNA into a plant host cell. These techniques include transformation of plant cells by injection (Newell (2000) *Mol Biotech* 16:53-65), microinjection (Griesbach (1987) *Plant Sci.* 50:69-77), electroporation of DNA (Fromm et al. (1985) *Proc. Natl. Acad. Sci. USA* 82:5824), PEG (Paszkowski et al. (1984) *EMBO J.* 3:2717), use of biolistics (Klein et al. (1987) *Nature* 327:773), fusion of cells or protoplasts (Willmitzer, L. (1993) Transgenic Plants. In: Iotechnology, A Multi-Volume Comprehensive treatise (H. J. Rehm, G. Reed, A. Püler, P. Stadler, eds., Vol. 2, 627-659, VCH Weinheim-New York-Basel-Cambridge), and via T-DNA using *Agrobacterium tumefaciens* (*Crit. Rev. Plant. Sci.* 4:1-46; Fromm et al. (1990) *Biotechnology* 8:833-844) or *Agrobacterium rhizogenes* (Cho et al. (2000) *Planta* 210:195-204) or other bacterial hosts (Brootghaerts et al. (2005) *Nature* 433:629-633), for example.

In addition, a number of non-stable transformation methods that are well known to those skilled in the art may be desirable for the present invention. Such methods include, but are not limited to, transient expression (Lincoln et al. (1998) *Plant Mol. Biol. Rep.* 16:1-4) and viral transfection (Lacomme et al. (2001), "Genetically Engineered Viruses" (C. J. A. Ring and E. D. Blair, Eds). Pp. 59-99, BIOS Scientific Publishers, Ltd. Oxford, UK).

Seeds are obtained from the transformed plants and used for testing stability and inheritance. Generally, two or more generations are cultivated to ensure that the phenotypic feature is stably maintained and transmitted.

A person of ordinary skill in the art recognizes that after the expression cassette is stably incorporated in transgenic plants and confirmed to be operable, it can be introduced into other plants by sexual crossing. Any of a number of standard breeding techniques can be used, depending upon the species to be crossed.

In aspects related to making transgenic plants, a typical step involves selection or screening of transformed plants, e.g., for the presence of a functional vector as evidenced by expression of a selectable marker. Selection or screening can be carried out among a population of recipient cells to identify transformants using selectable marker genes such as herbicide resistance genes. Physical and biochemical methods can be used to identify transformants. These include Southern analysis or PCR amplification for detection of a polynucleotide; Northern blots, S1 RNase protection, primer-extension, or RT-PCR amplification for detecting RNA transcripts; enzymatic assays for detecting enzyme or ribozyme activity of polypeptides and polynucleotides; and protein gel electrophoresis, Western blots, immunoprecipitation, and enzyme-linked immunoassays to detect polypeptides. Other techniques such as in situ hybridization, enzyme staining, and immunostaining also can be used to detect the presence or expression of polypeptides and/or polynucleotides. Methods for performing all of the referenced techniques are known.

A population of transgenic plants can be screened and/or selected for those members of the population that have a desired trait or phenotype conferred by expression of the transgene. For example, a population of progeny of a single transformation event can be screened for those plants having a desired level of expression of a heterologous salt tolerance polypeptide or nucleic acid. As an alternative, a population of plants comprising independent transformation events can be screened for those plants having a desired trait, such as salt tolerance. Selection and/or screening can be carried out over one or more generations, which can be useful to identify those plants that have a statistically significant difference in a protein level as compared to a corresponding level in a control plant. Selection and/or screening can also be carried out in more than one geographic location. In some cases, transgenic plants can be grown and selected under conditions which induce a desired phenotype or are otherwise necessary to produce a desired phenotype in a transgenic plant. In addition, selection and/or screening can be carried out during a particular developmental stage in which the phenotype is expected to be exhibited by the plant. Selection and/or screening can be carried out to choose those transgenic plants having a statistically significant difference in salt tolerance relative to a control plant that lacks the transgene. Selected or screened transgenic plants have an altered phenotype as compared to a corresponding control plant, as described elsewhere in this specification.

The nucleic acid molecules of the present invention may be used to confer the trait of improved tolerance to saline conditions. The invention has utility in improving important agronomic characteristics of crop plants, for example enabling plants to be productively cultivated in saline conditions. As noted above, transgenic plants that exhibit overexpression of the polynucleotides of the invention grow well under high salt conditions.

The nucleic acid molecules of the present invention encode appropriate proteins from any organism, but are preferably found in plants, fungi, bacteria or animals.

Transgenic Plant Phenotypes

Information that the polypeptides disclosed herein can modulate salt tolerance is useful in breeding of crop plants. Based on the effect of the disclosed polypeptides on salt tolerance, one can search for and identify polymorphisms linked to genetic loci for such polypeptides. Polymorphisms that can be identified include simple sequence repeats (SSRs), amplified fragment length polymorphisms (AFLPs) and restriction fragment length polymorphisms (RFLPs).

If a polymorphism is identified, its presence and frequency in populations is analyzed to determine if it is statistically significantly correlated to an increase in salt tolerance. Those polymorphisms that are correlated with an increase in salt tolerance can be incorporated into a marker assisted breeding program to facilitate the development of lines that have a desired increase in salt tolerance. Typically, a polymorphism identified in such a manner is used with polymorphisms at other loci that are also correlated with a desired increase in salt tolerance or other desired trait.

The methods according to the present invention can be applied to any plant, preferably higher plants, pertaining to the classes of Angiospermae and Gymnospermae. Plants of the subclasses of the Dicotylodenae and the Monocotyledonae are particularly suitable. Dicotyledonous plants belonging to the orders of the Magniolales, Illiciales, Laurales, Piperales Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, Santales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales, for example, are also suitable. Monocotyledonous plants belonging to the orders of the Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchidales also may be useful in embodiments of the present invention. Further examples include, but are not limited to, plants belonging to the class of the Gymnospermae are Pinales, Ginkgoales, Cycadales and Gnetales.

The methods of the present invention are preferably used in plants that are important or interesting for agriculture, horticulture, biomass for bioconversion and/or forestry. Non-limiting examples include, for instance, tobacco, oilseed rape, sugar beet, potatoes, tomatoes, cucumbers, peppers, beans, peas, citrus fruits, avocados, peaches, apples, pears, berries, plumbs, melons, eggplants, cotton, soybean, sunflowers, roses, poinsettia, petunia, guayule, cabbages, spinach, alfalfa, artichokes, sugarcane, mimosa, *Servicea lespedera*, corn, wheat, rice, rye, barley, sorghum and grasses such as switch grass, giant reed, Bermuda grass, Johnson grasses or turf grass, millet, hemp, bananas, poplars, eucalyptus trees and conifers. Of interest are plants grown for energy production, so called energy crops, such as broadleaf plants like alfalfa, hemp, Jerusalem artichoke and grasses such as sorghum, switchgrass, Johnson grass and the likes. Thus, the described materials and methods are useful for modifying biomass characteristics, such as characteristics of biomass renewable energy source plants. A biomass renewable energy source plant is a plant having or producing material (either raw or processed) that comprises stored solar energy that can be converted to fuel. In general terms, such plants comprise dedicated energy crops as well as agricultural and woody plants. Examples of biomass renewable energy source plants include: switchgrass, elephant grass, giant chinese silver grass, energycane, giant reed (also known as wild cane), tall fescue, bermuda grass, sorghum, napier grass, also known as uganda grass, triticale, rye, winter wheat, shrub poplar, shrub willow, big bluestem, reed canary grass and corn.

Homologues Encompassed by the Invention

It is known in the art that one or more amino acids in a sequence can be substituted with other amino acid(s), the charge and polarity of which are similar to that of the substituted amino acid, i.e. a conservative amino acid substitution, resulting in a biologically/functionally silent change. Conservative substitutes for an amino acid within the polypeptide sequence can be selected from other members of the class to which the amino acid belongs. Amino acids can be divided into the following four groups: (1) acidic (negatively charged) amino acids, such as aspartic acid and glutamic acid; (2) basic (positively charged) amino acids, such as arginine, histidine, and lysine; (3) neutral polar amino acids, such as serine, threonine, tyrosine, asparagine, and glutamine; and (4) neutral nonpolar (hydrophobic) amino acids such as glycine, alanine, leucine, isoleucine, valine, proline, phenylalanine, tryptophan, cysteine, and methionine.

Nucleic acid molecules of the present invention can comprise sequences that differ from those encoding a protein or fragment thereof selected from the group consisting of SEQ ID NOs. 80, 99, 106, 123, 132, 146, 154 and 172, respectively, due to the fact that the different nucleic acid sequence encodes a protein having one or more conservative amino acid changes.

Biologically functional equivalents of the polypeptides, or fragments thereof, of the present invention can have about 10 or fewer conservative amino acid changes, more preferably about 7 or fewer conservative amino acid changes, and most preferably about 5 or fewer conservative amino acid changes. In a preferred embodiment of the present invention, the polypeptide has between about 5 and about 500 conservative changes, more preferably between about 10 and about 300 conservative changes, even more preferably between about 25 and about 150 conservative changes, and most preferably between about 5 and about 25 conservative changes or between 1 and about 5 conservative changes.

Identification of Useful Nucleic Acid Molecules and their Corresponding Nucleotide Sequences The nucleic acid molecules, and nucleotide sequences thereof, of the present invention were identified by use of a variety of screens that are predictive of nucleotide sequences that provide plants with improved vegetative growth, growth rate, and/or biomass under saline conditions. One or more of the following screens were, therefore, utilized to identify the nucleotide (and amino acid) sequences of the present invention.

The present invention is further exemplified by the following examples. The examples are not intended to in any way limit the scope of the present application and its uses.

6. Experiments Confirming the Usefulness of the Polynucleotides and Polypeptides of the Invention General Protocols

*Agrobacterium*-Mediated Transformation of *Arabidopsis*

Host Plants and Transgenes: Wild-type *Arabidopsis thaliana Wassilewskija* (WS) plants are transformed with Ti plasmids containing nucleic acid sequences to be expressed, as noted in the respective examples, in the sense orientation relative to the 35S promoter in a Ti plasmid. A Ti plasmid vector useful for these constructs, CRS 338, contains the Ceres-constructed, plant selectable marker gene phosphinothricin acetyltransferase (PAT), which confers herbicide resistance to transformed plants.

Ten independently transformed events are typically selected and evaluated for their qualitative phenotype in the $T_1$ generation.

Preparation of Soil Mixture: 24 L Sunshine Mix #5 soil (Sun Gro Horticulture, Ltd., Bellevue, Wash.) is mixed with 16 L Therm-O-Rock vermiculite (Therm-O-Rock West, Inc., Chandler, Ariz.) in a cement mixer to make a 60:40 soil mixture. To the soil mixture is added 2 Tbsp Marathon 1% granules (Hummert, Earth City, Mo.), 3 Tbsp OSMOCOTE® 14-14-14 (Hummert, Earth City, Mo.) and 1 Tbsp Peters fertilizer 20-20-20 (J.R. Peters, Inc., Allentown, Pa.), which are first added to 3 gallons of water and then added to the soil and mixed thoroughly. Generally, 4-inch diameter pots are filled with soil mixture. Pots are then covered with 8-inch squares of nylon netting.

Planting: Using a 60 mL syringe, 35 mL of the seed mixture is aspirated. 25 drops are added to each pot. Clear propagation domes are placed on top of the pots that are then placed under 55% shade cloth and subirrigated by adding 1 inch of water.

Plant Maintenance: 3 to 4 days after planting, lids and shade cloth are removed. Plants are watered as needed. After 7-10 days, pots are thinned to 20 plants per pot using forceps. After 2 weeks, all plants are subirrigated with Peters fertilizer at a rate of 1 Tsp per gallon of water. When bolts are about 5-10 cm long, they are clipped between the first node and the base of stem to induce secondary bolts. Dipping infiltration is performed 6 to 7 days after clipping.

Preparation of *Agrobacterium*: To 150 mL fresh YEB is added 0.1 mL each of carbenicillin, spectinomycin and rifampicin (each at 100 mg/ml stock concentration). *Agrobacterium* starter blocks are obtained (96-well block with *Agrobacterium* cultures grown to an $OD_{600}$ of approximately 1.0) and inoculated one culture vessel per construct by transferring 1 mL from appropriate well in the starter block. Cultures are then incubated with shaking at 27° C. Cultures are spun down after attaining an $OD_{600}$ of approximately 1.0 (about 24 hours). 200 mL infiltration media is added to resuspend *Agrobacterium* pellets. Infiltration media is prepared by adding 2.2 g MS salts, 50 g sucrose, and 5 µL 2 mg/ml benzylaminopurine to 900 ml water.

Dipping Infiltration: The pots are inverted and submerged for 5 minutes so that the aerial portion of the plant is in the *Agrobacterium* suspension. Plants are allowed to grow normally and seed is collected.

High-throughput Phenotypic Screening of Misexpression Mutants: Seed is evenly dispersed into water-saturated soil in pots and placed into a dark 4° C. cooler for two nights to promote uniform germination. Pots are then removed from the cooler and covered with 55% shade cloth for 4-5 days. Cotyledons are fully expanded at this stage. FINALE® (Sanofi Aventis, Paris, France) is sprayed on plants (3 ml FINALE® diluted into 48 oz. water) and repeated every 3-4 days until only transformants remain.

Screening: Screening is routinely performed by high-salt agar plate assay and also by high-salt soil assay. Traits assessed in high-salt conditions include: seedling area, photosynthesis efficiency, salt growth index, and regeneration ability.

Seedling area: the total leaf area of a young plant about 2 weeks old.

Photosynthesis efficiency (Fv/Fm): Seedling photosynthetic efficiency, or electron transport via photosystem II, is estimated by the relationship between Fm, the maximum fluorescence signal and the variable fluorescence, Fv. Here, a reduction in the optimum quantum yield (Fv/Fm) indicates stress, and so can be used to monitor the performance of transgenic plants compared to non-transgenic plants under salt stress conditions.

Salt growth index=seedling area×photosynthesis efficiency (Fv/Fm).

PCR was used to amplify the DNA insert in one randomly chosen $T_2$ plant. This PCR product was then sequenced to confirm the sequence in the plants.

Assessing Tolerance to Salt Stress: Initially, independently transformed plant lines are selected and qualitatively evaluated for their tolerance to salt stress in the $T_1$ generation. The transformed lines that qualitatively show the strongest tolerance to salt stress in the $T_1$ generation are selected for further evaluation in the $T_2$ and $T_3$ generations. This evaluation involves sowing seeds from the selected transformed plant lines on MS agar plates containing either 100 mM or 150 mM NaCl and incubating the seeds for 5 to 14 days to allow for germination and growth.

Calculating SGI: After germination and growth, seedling area and photosynthesis efficiency of transformed lines and a wild-type control are determined. From these measurements, the Salt Growth Index (SGI) is calculated and compared between wild-type and transformed seedlings. The SGI calculation is made by averaging seedling area and photosynthesis efficiency measurements taken from two replicates of 36 seedlings for each transformed line and a wild-type control and performing a t-test.

Determining Transgene Copy Number: $T_2$ generation transformed plants are tested on BASTA™ plates in order to determine the transgene copy number of each transformed line. A BASTA™ resistant:BASTA™ sensitive segregation ratio of 3:1 generally indicates one copy of the transgene.

Results:

The following Examples provide information for polynucleotides and their encoded polypeptides useful for increasing tolerance to salt stress. Enhanced salt tolerance gives the opportunity to grow crops in saline conditions without stunted growth and diminished yields due to salt-induced ion imbalance, disruption of water homeostasis, inhibition of metabolism, damage to membranes, and/or cell death. The ability to grow crops in saline conditions would result in an overall expansion of arable land and increased output of land currently marginally productive due to elevated salinity

EXAMPLE 1

ME03807 (Ceres Clone 8686; SEQ ID No. 79)

Wild-type *Arabidopsis thaliana Wassilewskija* was transformed with a Ti plasmid carrying the 35S promoter operatively linked to Ceres Clone 8686. Two transformed lines, ME03807-02 and ME03807-03, showed the strongest qualitative tolerance to salt stress in a prevalidation assay (Table 1-1). Their tolerance to 150 mM NaCl was further evaluated in a validation assay for two generations. Segregation ratios (BASTA™ resistant:BASTA™ sensitive) indicated that ME03807-02 contains two copies of the transgene and that ME03807-03 carries one copy of the transgene.

TABLE 1-1

Prevalidation assay of ME03807 salt tolerance as compared to wild-type Ws

|  | WS Wild-type | ME03807-02 | ME03807-03 |
| --- | --- | --- | --- |
| Mean* | 0.0268 | 0.0397 | 0.0506 |
| Standard Error | 0.0006 | 0.0041 | 0.0038 |

*Average seedling area of 36 plants grown on MS agar plates containing 150 mM NaCl for 14 days When grown on MS agar plates containing 150 mM NaCl, ME03807-02 and ME03807-03 transgenic plants showed significantly increased seedling area and SGI relative to non-transgenic plants. As shown in Table 1-2, the T2-generation SGI value for ME03807-02 seedlings increased by 74.4% while ME03807-03 seedlings increased by 87.6% compared to non-transgenic control seedlings. In the $T_3$ generation, the SGI increase was 134.2% for ME03807-02 and 141.8% for ME03807-03. The differences between transgenic and non-transgenic seedlings are statistically significant under the t-test, and clearly demonstrate that the enhanced tolerance to salt stress is a result of the ectopic expression of Ceres Clone 8686 in the ME03807 transformant lines.

TABLE 1-2

Validation assay of ME03807 salt stress tolerance in two generations

| ME Events | SGI* of transgenics | | | SGI of pooled non-transgenics | | | t-Test | | % of SGI increase |
| --- | --- | --- | --- | --- | --- | --- | --- | --- | --- |
| | Avg | SE | N | Avg | SE | N | t-value | $t_{0.05}$ | |
| ME03807-02$T_2$ | 0.952 | 0.126 | 32 | 0.546 | 0.087 | 24 | 2.66 | 1.68 | 74.4 |
| ME03807-03$T_2$ | 0.604 | 0.047 | 24 | 0.322 | 0.065 | 13 | 3.51 | 1.70 | 87.6 |
| ME03807-02$T_3$ | 0.965 | 0.111 | 19 | 0.412 | 0.031 | 11 | 5.95 | 1.70 | 134.2 |
| ME03807-03$T_3$ | 1.064 | 0.104 | 42 | 0.440 | 0.028 | 16 | 9.60 | 1.68 | 141.8 |

*SGI (Salt Growth Index) = seedling area × Fv/Fm (photosynthesis efficiency)

Summary of Results:

Ectopic expression of Ceres Clone 8686 under the control of the 35S promoter enhances tolerance to salt stress that causes necrotic lesions and stunted growth in wild-type WS seedlings.

The protein encoded by Ceres Clone 8686 is a 255-amino-acid putative cyclase (Susstrunk et al. (1998) *Mol Microbiol*, 30(1):33-46 and Kang et al. (1999) *Microbiology*, 145:1161-72. Cyclase is a large gene family that includes adenylyl cyclase, which converts ATP to cAMP. cAMP is an important signal molecule that is involved in signal transduction which conveys signals from a plasma membrane receptor to cytosol cascades. The ME03807 transgene is more closely related to cyclase enzymes that are involved in antibiotic synthesis.

EXAMPLE 2

ME00774 (Ceres Clone 2767; SEQ ID No. 131)

Wild-type *Arabidopsis thaliana Wassilewskija* was transformed with a Ti plasmid carrying the 32449 promoter (SEQ ID No. 77) and Ceres Clone 2767. Two transformed lines, ME00774-03 and ME00774-04, showed the strongest qualitative tolerance to salt stress in a prevalidation assay (Table 2-1). Their tolerance to 150 mM NaCl was further evaluated in a validation assay for two generations. Segregation ratios (BASTA™ resistant:BASTA™ sensitive) indicated that ME00774-03 contains two copies of the transgene and that ME00774-04 carries one copy of the transgene.

TABLE 2-1

Prevalidation assay of ME00774 salt tolerance as compared to wild-type Ws

|  | Ws wild-type | ME00774-01 | ME00774-02 | ME00774-03 | ME00774-04 | ME00774-05 |
|---|---|---|---|---|---|---|
| Mean* | 0.0286 | 0.0313 | 0.0333 | 0.0468 | 0.0384 | 0.0343 |
| Std Error | 0.0006 | 0.0015 | 0.0019 | 0.0037 | 0.0026 | 0.0024 |

*Average seedling area of 36 plants grown on MS agar plates containing 150 mM NaCl for 14 days When grown on MS agar plates containing 150 mM NaCl, ME00774-03 and ME00774-04 transgenic plants showed significantly greater seedling area and SGI relative to non-transgenic plants. As shown in Table 2-2, the T2-generation SGI value for ME00774-03 seedlings increased by 41.8% while ME00774-04 seedlings increased by 379.4% compared to non-transgenic control seedlings. In the $T_3$ generation, the SGI increase was 315.1% for ME00774-03 and 551.8% for ME00774-04. The differences between transgenic and non-transgenic seedlings are statistically significant under the t-test, and clearly demonstrate that the enhanced tolerance to salt stress was a result of the ectopic expression of Ceres Clone 2767 in the ME00774 transformant lines.

TABLE 2-2

Validation assay of ME00774 on salt tolerance in two generations

| ME Events | SGI* of transgenics | | | SGI of pooled non-transgenics | | | t-Test | | % of SGI increase |
|---|---|---|---|---|---|---|---|---|---|
|  | Avg | SE | N | Avg | SE | N | t-value | $t_{0.05}$ |  |
| ME00774-03$T_2$ | 1.462 | 0.122 | 51 | 1.031 | 0.127 | 18 | 2.45 | 1.67 | 41.8 |
| ME00774-04$T_2$ | 0.954 | 0.072 | 20 | 0.199 | 0.03 | 10 | 9.78 | 1.70 | 379.4 |
| ME00774-03$T_3$ | 1.598 | 0.081 | 48 | 0.385 | 0.05 | 23 | 12.79 | 1.67 | 315.1 |
| ME00774-04$T_3$ | 1.082 | 0.091 | 20 | 0.166 | 0.032 | 16 | 9.52 | 1.70 | 551.8 |

*SGI (Salt Growth Index) = seedling area × Fv/Fm (photosynthesis efficiency)

Summary of Results:

Ectopic expression of Clone 2767 under the control of the 32449 promoter enhances tolerance to salt stress.

Ceres Clone 2767 encodes a 154-amino-acid protein that belongs to a universal stress protein family (Kerk et al. (2003) *Plant Physiol.* 131(3):1209-19). The USP superfamily has its members conserved in bacteria, archaea, and eukaryotes. The expression of USP genes in *E. coli* is induced by a large variety of environmental insults. The uspA gene plays an important role for *E. coli* to survive in cellular growth arrest, but the molecular mechanism of the gene function is not known yet (Nachin et al. (2005) *J Bacteriol* 187(18):6265-72). In *Arabidopsis*, there are 44 family members of USP. However, their function has not been characterized yet (Kerk et al. 2003). A rice homolog, OsUsp1, has been found to be induced by submergence and ethylene (Sauter et al. (2002) *J Exp Bot* 53(379):2325-31).

The identification of an AtUsp gene in a salt screen suggests that the *Arabidopsis* USP family members may play a similar role in stress tolerance as observed in *E. coli*.

EXAMPLE 3

ME0146 (Ceres Clone 16403; SEQ ID No. 145)

Wild-type *Arabidopsis thaliana Wassilewskija* was transformed with a Ti plasmid carrying the 35S promoter and Ceres Clone 16403. Two transformed lines, ME01468-01 and ME01468-04, showed the strongest qualitative tolerance to salt stress in a prevalidation assay (Table 3-1). Their tolerance to 100 mM NaCl was further evaluated in a validation assay for two generations. Segregation ratios (BASTA™ resistant: BASTA™ sensitive) indicated ME01468-01 and ME01468-04 transformed lines each carry one copy of the transgene.

TABLE 3-1

Prevalidation assay of ME00774 salt tolerance as compared to wild-type Ws

|  | Ws Wild-type | ME01468-01 | ME01468-02 | ME01468-03 | ME01468-04 |
|---|---|---|---|---|---|
| Mean* | 0.0268 | 0.0424 | 0.0312 | 0.0215 | 0.0395 |
| Standard Error | 0.0006 | 0.0032 | 0.0018 | 0.0027 | 0.0031 |

*Average seedling area of 36 plants grown on MS agar plates containing 150 mM NaCl for 14 days When grown on MS agar plates containing 100 mM NaCl, ME01468-01 and ME01468-04 transgenic plants showed significantly greater seedling area and SGI relative to non-transgenic plants. As shown in Table 3-1, the T2-generation SGI value for ME01468-01 seedlings increased by 23.7% while ME01468-04 seedlings increased by 39.3% compared to non-transgenic control seedlings. In the $T_3$ generation, the SGI increase was 83.7% for ME01468-01 and 79.4% for ME01468-04. The differences between transgenic and non-transgenic seedlings are statistically significant under the t-test, and clearly demonstrate that the enhanced tolerance to salt stress was a result of the ectopic expression of Ceres Clone 16403 in the ME01468 transformant lines.

TABLE 3-2

Validation assay of ME01468 on salt tolerance in two generations

| ME Events | SGI* of transgenics | | | SGI of pooled non-transgenics | | | t-Test | | % of SGI increase |
|---|---|---|---|---|---|---|---|---|---|
| | Avg | SE | N | Avg | SE | N | t-value | $t_{0.05}$ | |
| ME01468-01$T_2$ | 3.842 | 0.146 | 39 | 3.105 | 0.307 | 29 | 2.162 | 1.67 | 23.7 |
| ME01468-04$T_2$ | 3.143 | 0.179 | 35 | 2.256 | 0.261 | 32 | 2.795 | 1.67 | 39.3 |
| ME01468-01$T_3$ | 5.939 | 0.416 | 33 | 3.233 | 0.296 | 37 | 5.293 | 1.67 | 83.7 |
| ME01468-04$T_3$ | 7.508 | 0.524 | 13 | 4.186 | 0.469 | 21 | 4.719 | 1.70 | 79.4 |

*SGI (Salt Growth Index) = seedling area × Fv/Fm (photosynthesis efficiency)

Summary of Results:

Ectopic expression of Ceres Clone 16403 under the control of the 35S promoter enhances tolerance to high salt stress.

Ceres Clone 16403 encodes a 238-amino-acid calcium-binding protein that also shows similarity to an oxygen evolving complex from rice (Sanchez-Barrena et al. (2005) *J Mol Biol.* 345(5): 1253-64). It is worth noting that SOS3, an important gene involved in salt tolerance, has been molecularly characterized as a $Ca^{++}$ binding protein.

EXAMPLE 4

ME02064 (Ceres Clone 375578; SEQ ID No. 98)

Wild-type *Arabidopsis thaliana Wassilewskija* was transformed with a Ti plasmid carrying the 35S promoter and Ceres Clone 375578. Three transformed lines, ME02064-01 and ME02064-03, ME02064-04, showed the strongest qualitative tolerance to salt stress in a prevalidation assay (Table 4-1). Their tolerance to 150 mM NaCl was further evaluated in a validation assay for two generations. Segregation ratios (BASTA™ resistant:BASTA™ sensitive) indicated ME02064-01 and ME02064-03, ME02064-04 transformed lines each carry one copy of the transgene.

TABLE 4-1

Prevalidation assay of ME02064 salt tolerance as compared to wild-type Ws

| | Ws Wild-type | ME02064-01 | ME02064-02 | ME02064-03 | ME02064-04 | ME02064-05 |
|---|---|---|---|---|---|---|
| Mean* | 0.0359 | 0.0435 | 0.0346 | 0.0441 | 0.0438 | 0.0305 |
| Standard Error | 0.0016 | 0.0048 | 0.004 | 0.0041 | 0.0035 | 0.0019 |

*Average seedling area of 36 plants grown on MS agar plates containing 150 mM NaCl for 14 days When grown on MS agar plates containing 150 mM NaCl, ME02064-01 and ME02064-03, ME02064-04 transgenic plants showed significantly greater seedling area and SGI relative to non-transgenic plants. As shown in Table 4-2, the T2-generation SGI value for ME02064-01 seedlings increased by 110% while ME02064-03 seedlings increased by 131% and ME02064-04 seedlings increased by 72% compared to non-transgenic control seedlings. In the $T_3$ generation, the SGI increase was 43% for ME02064-01, 47% for ME02064-03, and 64% for ME02064-04. The differences between transgenic and non-transgenic seedlings are statistically significant, and clearly demonstrate that the enhanced tolerance to salt stress was a result of the ectopic expression of Ceres Clone 375578 in the ME02064 transformant lines.

TABLE 4-2

Validation assay of ME02064 on salt tolerance in two generations

| ME Events | SGI* of transgenics | | | SGI of pooled non-transgenics | | | t-Test | | % of SGI increase |
|---|---|---|---|---|---|---|---|---|---|
| | Avg | SE | N | Avg | SE | N | t-value | $t_{0.05}$ | |
| ME02064-01-$T_2$ | 2.057 | 0.249 | 12 | 0.977 | 0.205 | 17 | 3.35 | 1.70 | 110.5 |
| ME02064-03-$T_2$ | 2.237 | 0.371 | 5 | 0.968 | 0.140 | 24 | 3.20 | 1.70 | 131.1 |
| ME02064-04-$T_2$ | 1.810 | 0.146 | 14 | 1.055 | 0.135 | 13 | 3.81 | 1.70 | 71.6 |
| ME02064-01-$T_3$ | 2.438 | 0.170 | 21 | 1.708 | 0.289 | 9 | 2.18 | 1.70 | 42.7 |
| ME02064-03-$T_3$ | 2.837 | 0.257 | 20 | 1.927 | 0.271 | 14 | 2.43 | 1.70 | 47.2 |
| ME02064-04-$T_3$ | 2.770 | 0.318 | 16 | 1.688 | 0.188 | 19 | 2.93 | 1.70 | 64.1 |

*SGI (Salt Growth Index) = seedling area × Fv/Fm (photosynthesis efficiency)

Summary of Results:

Ectopic expression of Ceres Clone 375578 under the control of the 35S promoter enhances tolerance to salt stress that causes necrotic lesions and stunted growth in wild-type Ws seedlings.

Ceres Clone 375578 encodes a 311-amino-acid protein that belongs to the calmodulin binding family (Sanchez-Barrena et al. (2005) *J Mol Biol.* 345(5):1253-64). $Ca^{++}$ homeostasis is an important signaling cascade in abiotic and biotic resistance. A critical gene, SOS3, involved in salt tolerance has been previously identified to be a $Ca^{++}$ binding protein. Understanding the connection between SOS3 and the transgene in ME02064 will help to better engineer resistance to salt stress.

EXAMPLE 5

ME04074 (Ceres Clone 105319; SEQ ID No. 105)

Wild-type *Arabidopsis thaliana Wassilewskija* was transformed with a Ti plasmid carrying the 35S promoter and Ceres Clone 105319. Two transformed lines, ME04074-02 and ME04074-05, showed the strongest qualitative tolerance to salt stress in a prevalidation assay (Table 5-1). Their tolerance to 150 mM NaCl was further evaluated in a validation assay for two generations. Segregation ratios (BASTA™ resistant:BASTA™ sensitive) indicate ME04074-02 and ME04074-05 transformed lines each carry one copy of the transgene.

TABLE 5-1

Prevalidation assay of ME04074 salt tolerance as compared to wild-type Ws

| | Ws Wild-type | ME04074-01 | ME04074-02 | ME04074-03 | ME04074-04 | ME04074-05 |
|---|---|---|---|---|---|---|
| Mean* | 0.0301 | 0.0332 | 0.0423 | 0.0351 | 0.039 | 0.0448 |
| Standard Error | 0.0032 | 0.0027 | 0.0033 | 0.0026 | 0.0025 | 0.0027 |

*Average seedling area of 36 plants grown on MS agar plates containing 150 mM NaCl for 14 days When grown on MS agar plates containing 150 mM NaCl, ME04074-02 and ME04074-05 transgenic plants showed significantly greater seedling area and SGI relative to non-transgenic plants. As shown in Table 5-2, the T2-generation SGI value for ME04074-02 seedlings increased by 40.6% while ME04074-05 seedlings increased by 52.2% compared to non-transgenic control seedlings. In the $T_3$ generation, the SGI increase was 18.5% for ME04074-02 and 60.6% for ME04074-05. The differences between transgenic and non-transgenic seedlings are statistically significant under the t-test, and clearly demonstrate that the enhanced tolerance to salt stress was a result of the ectopic expression of Ceres Clone 105319 in the ME04074 transformant lines.

TABLE 5-2

Validation assay of ME04074 on salt tolerance in two generations

| | SGI* of transgenics | | | SGI of pooled non-transgenics | | | t-Test | | % of |
|---|---|---|---|---|---|---|---|---|---|
| ME Events | Avg | SE | N | Avg | SE | N | t-value | $t_{0.05}$ | SGI increase |
| ME04074-$0_2$-$T_2$ | 2.432 | 0.212 | 23 | 1.730 | 0.155 | 40 | 2.68 | 1.67 | 40.6 |
| ME04074-$0_5$-$T_2$ | 2.707 | 0.212 | 26 | 1.778 | 0.171 | 38 | 3.41 | 1.67 | 52.2 |
| ME04074-$0_2$-$T_3$ | 2.257 | 0.156 | 34 | 1.905 | 0.190 | 34 | 1.43 | 1.67 | 18.5 |
| ME04074-$0_5$-$T_3$ | 2.851 | 0.158 | 32 | 1.775 | 0.147 | 52 | 4.98 | 1.67 | 60.6 |

*SGI (Salt Growth Index) = seedling area × Fv/Fm (photosynthesis efficiency)

Summary of Results:

Ectopic expression of Ceres Clone 105319 under the control of the 35S promoter enhances tolerance to salt stress that causes necrotic lesions and stunted growth in wild-type Ws seedlings.

The protein encoded by Ceres Clone 105319 encodes a putative shikimate cyclase (Griffen et al. (1995) *DNA Seq* 5(3):195-197). The enzyme has ATP binding activity and catalyzes the fifth step in the biosynthesis of aromatic amino acids from chorismate. The protein is found in bacteria, fungi and plants. How this protein is involved in stress response is not yet known. However, aromatic acids, such as L-phenylalanine, are important substrates for the phenylpropanoid biosynthesis pathway, which produces many compounds related to stress responses.

EXAMPLE 6

ME02907 (Ceres Clone 29658; SEQ ID No. 122)

Wild-type *Arabidopsis thaliana Wassilewskija* was transformed with a Ti plasmid carrying the 35S promoter and Ceres Clone 29658. Three transformed lines, ME02907-01, ME02907-03 and ME02907-05, showed the strongest qualitative tolerance to salt stress in a prevalidation assay (Table 6-1). Their tolerance to 150 mM NaCl was further evaluated in a validation assay using ME02907-03 and ME02907-05 for two generations. Segregation ratios (BASTA™ resistant:BASTA™ sensitive) indicated ME02907-03 and ME02907-05 transformed lines each carry one copy of the transgene.

TABLE 6-1

Prevalidation assay of ME02907 salt tolerance as compared to wild-type Ws

| | Ws Wild-type | ME02907-01 | ME02907-03 | ME02907-04 | ME02907-05 |
|---|---|---|---|---|---|
| Mean* | 0.0268 | 0.034483 | 0.0315 | 0.0224 | 0.0368 |
| Standard Error | 0.0006 | 0.002016 | 0.0029 | 0.0031 | 0.0039 |

*Average seedling area of 36 plants grown on MS agar plates containing 150 mM NaCl for 14 days When grown on MS agar plates containing 150 mM NaCl, ME02907-03 and ME02907-05 transgenic plants showed significantly greater seedling area and SGI relative to non-transgenic plants. As shown in Table 6-2, the T2-generation SGI value for ME02907-03 seedlings increased by 59% while ME02907-05 seedlings increased by 67% as compared to non-transgenic control seedlings. In the $T_3$ generation, the SGI increase was 110% for ME02907-03 and 99% for ME02907-05. The differences between transgenic and non-transgenic seedlings are statistically significant under the t-test, and clearly demonstrate that the enhanced tolerance to salt stress was a result of the ectopic expression of Ceres Clone 29658 in the ME02907 transformant lines.

TABLE 6-2

Validation assay of ME02907 on salt tolerance in two generations

| ME Events | SGI* of transgenics | | | SGI of pooled non-transgenics | | | t-Test | | % of |
|---|---|---|---|---|---|---|---|---|---|
| | Avg | SE | N | Avg | SE | N | t-value | $t_{0.05}$ | SGI increase |
| ME02907-03-$T_2$ | 1.252 | 0.115 | 31 | 0.787 | 0.121 | 18 | 2.79 | 1.68 | 59.1 |
| ME02907-05-$T_2$ | 1.235 | 0.120 | 34 | 0.738 | 0.100 | 28 | 3.18 | 1.67 | 67.3 |
| ME02907-03-$T_3$ | 1.039 | 0.100 | 26 | 0.495 | 0.023 | 15 | 7.40 | 1.69 | 109.9 |
| ME02907-05-$T_3$ | 1.157 | 0.064 | 37 | 0.582 | 0.070 | 17 | 7.53 | 1.70 | 98.8 |

*SGI (Salt Growth Index) = seedling area × Fv/Fm (photosynthesis efficiency)

Summary of Results:

Ectopic expression of Ceres Clone 29658 under the control of the 35S promoter enhances tolerance to salt stress that causes necrotic lesions and stunted growth in wild-type Ws seedlings.

The protein encoded by Ceres Clone 29658 is a putative calmodulin. Sanchez-Barrena et al. *J Mol Biol.* 345(5): 1253-64. $Ca^{++}$-mediated signaling is critical in salt tolerance. SOS3 has been demonstrated to confer salt tolerance in *Arabidopsis* and it has $Ca^{++}$-binding activity.

EXAMPLE 7

ME00199 (Ceres Clone 3964; SEQ ID No. 153)

Wild-type *Arabidopsis thaliana Wassilewskija* was transformed with a Ti plasmid carrying the 32499 promoter and Ceres Clone 3964. Two transformed lines, ME00199-02 and ME00199-03, showed the strongest qualitative tolerance to salt stress in a prevalidation assay (Table 7-1). Their tolerance to 100 mM NaCl was further evaluated in a validation assay for two generations. Segregation ratios (BASTA™ resistant: BASTA™ sensitive) indicated ME00199-02 and ME00199-03 transformed lines each carry one copy of the transgene.

TABLE 7-1

Prevalidation assay of ME00199 salt tolerance as compared to wild-type Ws

| | Ws wild-type | ME00199-01-01 | ME00199-02-01 | ME00199-03-01 |
|---|---|---|---|---|
| Mean* | 0.0268 | 0.0244 | 0.0401 | 0.0307 |
| Standard Error | 0.0006 | 0.0025 | 0.0052 | 0.0037 |

*Average seedling area of 36 plants grown on MS agar plates containing 150 mM NaCl for 14 days When grown on MS agar plate containing 100 mM NaCl, ME00199-02 and ME00199-03 transgenic plants showed significantly greater seedling area and SGI relative to non-transgenic plants. As shown in Table 7-2, the SGI value of T2-generation ME00199-02 seedlings increased by 106.6% and the SGI value of $T_2$-generation ME00199-03 seedlings increased by 48.2% as compared to non-transgenic control seedlings. In the $T_3$ generation, the SGI increase was 174.3% for ME00199-02 and 205.9% for ME00199-03. The differences between transgenic and non-transgenic seedlings are statistically significant under the t-test, and clearly demonstrate that the enhanced tolerance to salt stress was a result of the ectopic expression of Ceres Clone 3964 in the ME00199 transformant lines.

TABLE 7-2

Validation assay of ME00199 on salt tolerance in two generations

| ME Events | SGI* of transgenics | | | SGI of pooled non-transgenics | | | t-Test | | % of |
|---|---|---|---|---|---|---|---|---|---|
| | Avg | SE | N | Avg | SE | N | t-value | $t_{0.05}$ | SGI increase |
| ME00199-02$T_3$ | 4.6025 | 0.3400 | 43 | 2.2277 | 0.2159 | 28 | 5.90 | 1.67 | 106.6 |
| ME00199-03$T_3$ | 3.8795 | 0.3444 | 40 | 2.6182 | 0.3855 | 28 | 2.44 | 1.67 | 48.2 |
| ME00199-02$T_4$ | 6.8743 | 0.5132 | 45 | 2.5058 | 0.5904 | 12 | 5.58 | 1.68 | 174.3 |
| ME00199-03$T_4$ | 7.4472 | 0.7392 | 30 | 2.4343 | 0.5283 | 15 | 5.52 | 1.68 | 205.9 |

SGI (Salt Growth Index) = seedling area × Fv/Fm (photosynthesis efficiency)

Summary of Results:

Ectopic expression of Ceres Clone 3964 under the control of the 32499 promoter enhances tolerance to salt stress that causes necrotic lesions and stunted growth in wild-type Ws seedlings.

The protein encoded by Ceres Clone 3964 is a putative steroid sulfotransferase (351 AA).

EXAMPLE 8

ME09814 (Ceres Clone 965405; SEQ ID No. 171)

Wild-type *Arabidopsis thaliana Wassilewskija* was transformed with a Ti plasmid carrying the 35S promoter and Ceres Clone 965405. Two transformed lines, ME09814-01 and ME09814-02, showed the strongest qualitative tolerance to salt stress in a prevalidation assay. Their tolerance to 100 mM NaCl was further evaluated in a validation assay for two generations. Segregation ratios (BASTA™ resistant: BASTA™ sensitive) indicated ME09814-01 and ME09814-02 transformed lines each carry one copy of the transgene originated from *Brassica napus* subsp. *napus* (canola).

Grown on MS agar plates containing 100 mM NaCl, ME09814-01 and ME09814-02 transgenic plants showed significantly greater seedling area and SGI relative to non-transgenic plants. As shown in Table 8-1, the SGI value of T2-generation ME09814-01 seedlings increased by 29% and the SGI value of T2-generation ME09814-02 seedlings increased by 69% as compared to non-transgenic control seedlings. In the $T_3$ generation, the SGI increase was 80% for ME09814-01 and 49% for ME09814-02. The differences between transgenic and non-transgenic seedlings are statistically significant under the t-test, and clearly demonstrate that the enhanced tolerance to salt stress was a result of the ectopic expression of Ceres Clone 965405 in the ME09814 transgenic lines.

TABLE 8-1

Validation assay of ME09814 on salt tolerance in two generations

| ME Events | SGI* of transgenics | | | SGI of pooled non-transgenics | | | t-Test | | % of |
|---|---|---|---|---|---|---|---|---|---|
| | Avg | SE | N | Avg | SE | N | t-value | $t_{0.05}$ | SGI increase |
| ME09814-01$T_2$ | 2.6841 | 0.2346 | 37 | 2.0812 | 0.1830 | 34 | 2.03 | 1.67 | 29.0 |
| ME09814-02$T_2$ | 2.6985 | 0.2438 | 32 | 1.5942 | 0.1909 | 38 | 3.57 | 1.67 | 69.3 |
| ME09814-01$T_3$ | 3.0664 | 0.2934 | 29 | 1.6996 | 0.1724 | 42 | 4.02 | 1.67 | 80.4 |
| ME09814-02$T_3$ | 2.6878 | 0.2350 | 36 | 1.8087 | 0.1743 | 34 | 3.00 | 1.67 | 48.6 |

*SGI (Salt Growth Index) = seedling area × Fv/Fm (photosynthesis efficiency)

Summary of Results:
Ectopic expression of Ceres Clone 965405 under the control of the 35S promoter enhances tolerance to salt stress that causes necrotic lesions and stunted growth in wild-type Ws seedlings.
The protein encoded by Ceres Clone 965405 is an unknown protein.

EXAMPLE 9

ME07361 (Ceres Clone 5367; SEQ ID NO: 245)

Wild-type *Arabidopsis thaliana Wassilewskija* was transformed with a Ti plasmid carrying the 35S promoter and Ceres Clone 5367. Ceres Clone 5367 is a functional homolog of Ceres clone 965405.

Grown on MS agar plates containing 100 mM NaCl, ME07361-04 transgenic plants showed significantly greater seedling area and SGI relative to non-transgenic plants. As shown in Table 9-1, the SGI value of T2-generation ME07361-03 seedlings increased by 30.34% and the SGI value of T2-generation ME07361-04 seedlings increased by 52% as compared to non-transgenic control seedlings. The differences between transgenic and non-transgenic seedlings are statistically significant under the t-test, and clearly demonstrate that the enhanced tolerance to salt stress was a result of the ectopic expression of Ceres Clone 5367 in the ME07361 transgenic lines.

TABLE 9-1

Results of ME07361 on salt tolerance assay in T2 generations

| ME Events | SGI* of transgenics | | | SGI of pooled non-transgenics | | | t-Test | SGI |
|---|---|---|---|---|---|---|---|---|
| | Avg | SE | N | Avg | SE | N | p-value | increase |
| ME07361-01 | 0.89 | 0.103 | 16 | 0.89 | 0.105 | 20 | 0.489 | −0.45% |
| ME07361-02 | 1.30 | 0.160 | 17 | 1.22 | 0.132 | 18 | 0.357 | 06.29% |
| ME07361-03 | 1.58 | 0.195 | 21 | 1.21 | 0.151 | 15 | 0.073 | 30.34% |
| ME07361-04 | 1.98 | 0.369 | 15 | 1.30 | 0.145 | 21 | 0.049 | 52.00% |

*SGI (Salt Growth Index) = seedling area × Fv/Fm (photosynthesis efficiency)

Transgenic plants of ME07361-04 showed significant better tolerance to high salt than pooled non-transgenics.
Summary of Results:
Ectopic expression of Ceres Clone 5367 under the control of the 35S promoter enhances tolerance to salt stress that causes necrotic lesions and stunted growth in wild-type Ws seedlings.

EXAMPLE 10

ME09594 (Annot ID 566551; SEQ ID NO: 290)

Wild-type *Arabidopsis thaliana Wassilewskija* was transformed with a Ti plasmid carrying the 35S promoter and Annot ID 566551. Annot ID 566551 is a functional homolog of Ceres clone 965405.

Grown on MS agar plates containing 100 mM NaCl, ME09594-03 transgenic plants showed significantly greater seedling area and SGI relative to non-transgenic plants. As shown in Table 10-1, the SGI value of T2-generation ME09594-03 seedlings increased by 60.09% as compared to non-transgenic control seedlings. The differences between transgenic and non-transgenic seedlings are statistically significant under the t-test, and clearly demonstrate that the enhanced tolerance to salt stress was a result of the ectopic expression of Annot ID 566551 in the ME09594 transgenic lines.

TABLE 10-1

Results of ME09594 on salt tolerance assay in T2/T3 generation

| ME Events | SGI* of transgenics | | | SGI of pooled non-transgenics | | | t-Test | SGI |
|---|---|---|---|---|---|---|---|---|
| | Avg | SE | N | Avg | SE | N | p-value | increase |
| ME09594-01 | 2.17 | 0.357 | 19 | 2.36 | 0.352 | 16 | 0.357 | −7.87% |
| ME09594-02-99 | 1.83 | 1.109 | 4 | 1.72 | 0.252 | 24 | 0.463 | 6.20% |
| ME09594-03 | 2.32 | 0.380 | 24 | 1.45 | 0.280 | 9 | 0.038 | 60.09% |
| ME09594-04-99 | 0.71 | 0.110 | 16 | 0.79 | 0.082 | 17 | 0.288 | −9.82% |
| ME09594-05 | 2.38 | 0.465 | 13 | 2.69 | 0.392 | 21 | 0.305 | −11.66% |

*SGI (Salt Growth Index) = seedling area × Fv/Fm (photosynthesis efficiency)

Transgenic plants of ME09594-03 showed significant better tolerance to high salt than pooled non-transgenics.

Summary of Results:

Ectopic expression of Annot ID 566551 under the control of the 35S promoter enhances tolerance to salt stress that causes necrotic lesions and stunted growth in wild-type Ws seedlings.

EXAMPLE 11

ME23428 (Annot ID 842118; SEQ ID NO: 289)

Wild-type *Arabidopsis thaliana Wassilewskija* was transformed with a Ti plasmid carrying the 35S promoter and Annot ID 842118. Annot ID 842118 is a functional homolog of Ceres clone 29658.

Grown on MS agar plates containing 100 mM NaCl, ME23428-02 transgenic plants showed significantly greater seedling area and SGI relative to non-transgenic plants. As shown in Table 11-1, the SGI value of T2-generation ME23428-02 seedlings increased by 81.77% as compared to non-transgenic control seedlings. The differences between transgenic and non-transgenic seedlings are statistically significant under the t-test, and clearly demonstrate that the enhanced tolerance to salt stress was a result of the ectopic expression of Annot ID 842118 in the ME23428 transgenic lines.

TABLE 11-1

Results of ME23428 on salt tolerance assay in T2 generation

| ME Events | SGI* of transgenics | | | SGI of pooled non-transgenics | | | t-Test | SGI |
|---|---|---|---|---|---|---|---|---|
| | Avg | SE | N | Avg | SE | N | p-value | increase |
| ME23428-01 | 1.26 | 0.166 | 9 | 1.76 | 0.283 | 26 | 0.069 | −28.36% |
| ME23428-02 | 1.17 | 0.134 | 18 | 0.65 | 0.139 | 11 | 0.005 | 81.77% |
| ME23428-03 | 0.63 | 0.036 | 13 | 0.64 | 0.039 | 19 | 0.386 | −2.43% |
| ME23428-04 | 0.93 | 0.108 | 18 | 0.84 | 0.222 | 13 | 0.371 | 9.72% |
| ME23428-05 | 0.99 | 0.144 | 19 | 0.97 | 0.166 | 14 | 0.466 | 1.96% |

*SGI (Salt Growth Index) = seedling area × Fv/Fm (photosynthesis efficiency)

Transgenic plants of ME23428-02 showed significant better tolerance to high salt than pooled non-transgenics.

Summary of Results:

Ectopic expression of Annot ID 842118 under the control of the 35S promoter enhances tolerance to salt stress that causes necrotic lesions and stunted growth in wild-type Ws seedlings.

EXAMPLE 12

ME24903 (Clone 295570; SEQ ID NO: 275)

Wild-type *Arabidopsis thaliana Wassilewskija* was transformed with a Ti plasmid carrying the 35S promoter and Ceres clone 295570. Ceres clone 295570 is a functional homolog of Ceres clone 8686.

Grown on MS agar plates containing 100 mM NaCl, ME24903-04, ME24903-05 ME24903-07 and ME24903-09 transgenic plants showed significantly greater seedling area and SGI relative to non-transgenic plants. As shown in Table 12-1, the SGI value of T2-generation ME24903-04 seedlings increased by 68.42%, the SGI value of T2-generation ME24903-05 seedlings increased by 55.99%, the SGI value of T2-generation ME24903-07 seedlings increased by 140.73% and the SGI value of T2-generation ME24903-09 seedlings increased by 121.46% as compared to non-transgenic control seedlings. The differences between transgenic and non-transgenic seedlings are statistically significant under the t-test, and clearly demonstrate that the enhanced tolerance to salt stress was a result of the ectopic expression of Ceres clone 295570 in the ME24903 transgenic lines.

TABLE 12-1

Results of ME24903 on salt tolerance assay in T2 generation

| ME Events | SGI* of transgenics | | | SGI of pooled non-transgenics | | | t-Test | SGI |
|---|---|---|---|---|---|---|---|---|
| | Avg | SE | N | Avg | SE | N | p-value | increase |
| ME24903-04 | 0.97 | 0.141 | 19 | 0.58 | 0.091 | 15 | 0.0123 | 68.42% |
| ME24903-05 | 1.72 | 0.221 | 18 | 1.10 | 0.160 | 17 | 0.0153 | 55.99% |
| ME24903-07 | 1.51 | 0.229 | 21 | 0.63 | 0.112 | 12 | 0.0008 | 140.73% |
| ME24903-08 | 0.89 | 0.087 | 18 | 0.79 | 0.208 | 12 | 0.3241 | 13.22% |
| ME24903-09 | 1.86 | 0.303 | 14 | 0.84 | 0.104 | 20 | 0.0016 | 121.46% |

*SGI (Salt Growth Index) = seedling area × Fv/Fm (photosynthesis efficiency)

Transgenic plants of ME24903-04, -5, -7 and -09 showed significant better tolerance to high salt than pooled non-transgenics.

Summary of Results:

Ectopic expression of Ceres clone 295570 under the control of the 35S promoter enhances tolerance to salt stress that causes necrotic lesions and stunted growth in wild-type Ws seedlings.

EXAMPLE 13

ME10681 (Clone 335348; SEQ ID NO: 314)

Wild-type *Arabidopsis thaliana Wassilewskija* was transformed with a Ti plasmid carrying the 35S promoter and Ceres clone 335348. Ceres clone 335348 is a functional homolog of Ceres clone 375578.

Grown on MS agar plates containing 100 mM NaCl, ME10681-02, ME10681-04, and ME10681-05 transgenic plants showed significantly greater seedling area and SGI relative to non-transgenic plants. As shown in Table 13-1, the SGI value of T2-generation, the SGI value of T2-generation ME10681-02 seedlings increased by 119.17%, the SGI value of T2-generation ME10681-04 seedlings increased by 113.51% and the SGI value of T2-generation ME10681-05 seedlings increased by 103.98% as compared to non-transgenic control seedlings. The differences between transgenic and non-transgenic seedlings are statistically significant under the t-test, and clearly demonstrate that the enhanced tolerance to salt stress was a result of the ectopic expression of Ceres clone 335348 in the ME10681 transgenic lines.

TABLE 13-1

Results of ME10681 on salt tolerance assay in T2 generation

| ME Events | SGI* of transgenics | | | SGI of pooled non-transgenics | | | t-Test p-value | SGI increase |
|---|---|---|---|---|---|---|---|---|
| | Avg | SE | N | Avg | SE | N | | |
| ME10681-01 | 3.87 | 0.6837 | 9 | 2.78 | 0.4324 | 24 | 0.0940 | 39.17% |
| ME10681-02 | 4.13 | 0.3354 | 25 | 1.89 | 0.5752 | 11 | 0.0009 | 119.17% |
| ME10681-04 | 6.22 | 0.4787 | 12 | 2.91 | 0.5671 | 15 | 7.66E−05 | 113.51% |
| ME10681-05 | 5.25 | 0.3916 | 20 | 2.57 | 0.6140 | 15 | 0.0004 | 103.98% |

*SGI (Salt Growth Index) = seedling area × Fv/Fm (photosynthesis efficiency)

Transgenic plants of ME10681-02, -04 and -05 showed significant better tolerance to high salt than pooled non-transgenics.

Summary of Results:

Ectopic expression of Ceres clone 335348 under the control of the 35S promoter enhances tolerance to salt stress that causes necrotic lesions and stunted growth in wild-type Ws seedlings.

EXAMPLE 14

Determination of Functional Homolog Sequences

The sequences described in the above Examples are utilized as query sequences to identify functional homologs of the query sequences and, together with those sequences, are utilized to define consensus sequences for a given group of query and functional homolog sequences. Query sequences and their corresponding functional homolog sequences are aligned to illustrate conserved amino acids consensus sequences that contain frequently occurring amino acid residues at particular positions in the aligned sequences, as shown in FIGS. 1-9.

A subject sequence is considered a functional homolog of a query sequence if the subject and query sequences encode proteins having a similar function and/or activity. A process known as Reciprocal BLAST (Rivera et al. (1998) *Proc. Natl Acad. Sci. USA* 95:6239-6244) is used to identify potential functional homolog sequences from databases consisting of all available public and proprietary peptide sequences, including NR from NCBI and peptide translations from Ceres clones.

Before starting a Reciprocal BLAST process, a specific query polypeptide is searched against all peptides from its source species using BLAST in order to identify polypeptides having sequence identity of 80% or greater to the query polypeptide and an alignment length of 85% or greater along the shorter sequence in the alignment. The query polypeptide and any of the aforementioned identified polypeptides are designated as a cluster.

The main Reciprocal BLAST process consists of two rounds of BLAST searches; forward search and reverse search. In the forward search step, a query polypeptide sequence, "polypeptide A," from source species $S^A$ is BLASTed against all protein sequences from a species of interest. Top hits are determined using an E-value cutoff of $10^{-5}$ and an identity cutoff of 35%. Among the top hits, the sequence having the lowest E-value is designated as the best hit, and considered a potential functional homolog. Any other top hit that had a sequence identity of 80% or greater to the best hit or to the original query polypeptide is considered a potential functional homolog as well. This process is repeated for all species of interest.

In the reverse search round, the top hits identified in the forward search from all species are used to perform a BLAST search against all protein or polypeptide sequences from the source species $S^A$. A top hit from the forward search that returned a polypeptide from the aforementioned cluster as its best hit is also considered as a potential functional homolog.

Functional homologs are identified by manual inspection of potential functional homolog sequences. Representative functional homologs are shown in FIGS. 1-9. The Figures represents a grouping of a query sequence aligned with the corresponding identified functional homolog subject sequences. Query sequences and their corresponding functional homolog sequences are aligned to identify conserved amino acids and to determine a consensus sequence that contains a frequently occurring amino acid residue at particular positions in the aligned sequences, as shown in FIGS. 1-9.

An HMM was made based on SEQ ID NOs: 80, 84, 85, 90, 92, 93 and 95, aligned in FIG. 1. When fit to the HMM, SEQ ID NOs: 80, 81, 82, 83, 84, 85, 86, 87, 89, 90, 91, 92, 93, 95, 97, 182, 184, 186, 188, 190, 191, and 192 gave HMM bit scores of 576.8, 394.8, 231.4, 382.2, 523.7, 632.7, 39.3, 409.6, 386.4, 569.7, 551.4, 621.4, 635.3, 633.5, 573.9, 543.4, 594.6546.7, 493.1, 613.4, and 635.3, respectively.

An HMM was made based on SEQ ID NOs: 100, 252, 298, 301, 302, 303 and 312 aligned in FIG. 2. When fit to the HMM, SEQ ID NOs: 100, 102, 103, 104, 252, 298, 300, 301, 302, 303 and 312 gave HMM bit scores of 1315.8, 208.1, 118.5, 173.9, 1272.1, 1235.9, 635.2, 1206.4, 225.6, 1212.9 and 1233.4, respectively.

An HMM was made based on SEQ ID NOs: 106, 107, 112, 113, 114 and 115, aligned in FIG. 3. When fit to the HMM, SEQ ID NOs: 106, 107, 109, 110, 111, 112, 113, 114, 115, 116, 117, 118, 119, 121, 194, 196, 197, 198 and 200 gave HMM bit scores of 593.7, 487.6, 238.4, 113.8, 492.6, 536.1, 524.8, 289.4, 624.9, 288.2, 476.4, 282.4, 489.3, 588.8, 545.8, 503.3, 491.5, 486, 504.9, respectively.

An HMM was made based on SEQ ID NOs: 123, 125, 126, 127, 128, 129 and 130, aligned in FIG. 4. When fit to the HMM, SEQ ID NOs: 123, 125, 126, 127, 128, 129. 130, 270 and 284 gave HMM bit scores of 390.1, 327.9, 392.3, 396.5, 394.8, 393.7, 323.8, 330.6 and 235.5, respectively.

An HMM was made based on SEQ ID NOs: 132, 134, 139, 142 and 143, aligned in FIG. 5. When fit to the HMM, SEQ ID NOs: 132, 134, 136, 138, 139, 141, 142, 143 and 144 gave HMM bit scores of 343.8, 454.5, 208, 197, 388.2, 144.1, 319.9, 375.2 and 295.2, respectively.

An HMM was made based on SEQ ID NOs: 146, 147, 149, 151 and 152, aligned in FIG. 6. When fit to the HMM, SEQ ID NOs: 146, 147, 149, 150, 151, 152, 202, 204 and 206 gave HMM bit scores of 593.1, 602.9, 570.8, 355.3, 633.9, 570.8, 369.3, 474.7 and 357.4, respectively.

An HMM was made based on SEQ ID NOs: 154, 157, 160, 161, 163, 164, 168, and 169, aligned in FIG. 7. When fit to the HMM, SEQ ID NOs: 154, 155, 157, 159, 160, 161, 162, 163, 164, 165, 166, 167, 168, 169, 170, 274, 278, 282, 286 and 288 gave HMM bit scores of 894.1, 719.9, 901.3, 801.4, 747, 810.2, 692.7, 748.7, 779.9, 656.3, 603.6, 485.1, 816.9, 634.5, 149, 498, 510, 584.3, 455.2 and 670.6, respectively.

An HMM was made based on SEQ ID NOs: 172, 173, 174, 175, 176, 177 and 179, aligned in FIG. 8. When fit to the HMM, SEQ ID NOs: 172, 173, 174, 175, 176, 177, 179, 208, 210, 212 and 213 gave HMM bit scores of 533.9, 542, 570.8, 559.9, 547.5, 474.8, 531.3, 414.3, 447.1, 358.5 and 344, respectively.

An HMM was made based on SEQ ID NOs: 304, 305, 306, 307, 308, 309, 310 and 311, aligned in FIG. 9. When fit to the HMM, SEQ ID NOs: 100, 102, 103, 104, 252, 298, 300, 301, 302, 303, 304, 305, 306, 307, 308, 309, 310, 311 and 312 gave HMM bit scores of 418.9, 208.1, 118.5, 173.9, 407.6, 490.5, 156.9, 461, 462, 469.6, 462, 461, 406.7, 462, 469.6, 418.9, 490.5 and 493.3, 493.3 respectively.

Useful polypeptides of the invention include each of the sequences and corresponding functional homolog sequences shown in the Figures and/or the Sequence Listing, as well as polypeptides belonging to the corresponding consensus sequence families as delineated by HMMs. In different embodiments, consensus sequence families have HMM bit score lower limits as about 50%, 60%, 70%, 80%, 90%, or 95% of any of the HMM bit scores of the family members presented in this application. In some embodiments the lower HMM bit score limits correspond approximately to the HMM bit score of any of the family members disclosed in this application. A sequence that has an HMM bit score of 20 means that it has a 95% likelihood of belonging to the consensus sequence defined by a particular HMM. Alternative HMM bit scores that are useful for the current invention are 50, 75, 100, 125, 150, 200, 250, 300, 350, 400, 450 and 500.

The present invention further encompasses nucleotides that encode the above described polypeptides, as well as the complements thereof, and including alternatives thereof based upon the degeneracy of the genetic code.

The invention being thus described, it will be apparent to one of ordinary skill in the art that various modifications of the materials and methods for practicing the invention can be made. Such modifications are to be considered within the scope of the invention as defined by the following claims.

The following references are cited in the Specification. Each of the references from the patent and periodical literature cited herein is hereby expressly incorporated in its entirety by such citation.

REFERENCES (1) Zhang et al. (2004) *Plant Physiol.* 135:615.
(2) Salomon et al. (1984) *EMBO J.* 3:141.
(3) Herrera-Estrella et al. (1983) *EMBO J.* 2:987.
(4) Escudero et al. (1996) *Plant J.* 10:355.
(5) Ishida et al. (1996) *Nature Biotechnology* 14:745.
(6) May et al. (1995) *Bio/Technology* 13:486)
(7) Armaleo et al. (1990) *Current Genetics* 17:97.
(8) Smith. T. F. and Waterman, M. S. (1981) *Adv. App. Math.* 2:482.
(9) Needleman and Wunsch (1970) *J. Mol. Biol.* 48:443.
(10) Pearson and Lipman (1988) *Proc. Natl. Acad. Sci. (USA)* 85: 2444.
(11) Yamauchi et al. (1996) *Plant Mol Biol.* 30:321-9.
(12) Xu et al. (1995) *Plant Mol. Biol.* 27:237.
(13) Yamamoto et al. (1991) *Plant Cell* 3:371.
(14) P. Tijessen, "Hybridization with Nucleic Acid Probes" In Laboratory Techniques in Biochemistry and Molecular Biology, P. C. vand der Vliet, ed., c. 1993 by Elsevier, Amsterdam.
(15) Bonner et al., (1973) *J. Mol. Biol.* 81:123.
(16) Sambrook et al., Molecular Cloning: A Laboratory Manual, Second Edition, Cold Spring Harbor Laboratory Press, 1989, New York.
(17) Shizuya et al. (1992) *Proc. Natl. Acad. Sci. USA,* 89: 8794-8797.
(18) Hamilton et al. (1996) *Proc. Natl. Acad. Sci. USA,* 93: 9975-9979.
(19) Burke et al. (1987) *Science,* 236:806-812.
(20) Sternberg N. et al. (1990) *Proc Natl Acad Sci USA.,* 87:103-7.
(21) Bradshaw et al. (1995) *Nucl Acids Res,* 23: 4850-4856.
(22) Frischauf et al. (1983) *J. Mol Biol,* 170: 827-842.
(23) Huynh et al., Glover N M (ed) DNA Cloning: A practical Approach, Vol. 1 Oxford: IRL Press (1985).
(24) Walden et al. (1990) *Mol Cell Biol* 1: 175-194.
(25) Vissenberg et al. (2005) *Plant Cell Physiol* 46:192.
(26) Husebye et al. (2002) *Plant Physiol* 128:1180.
(27) Plesch et al. (2001) *Plant J* 28:455.
(28) Weising et al. (1988) *Ann. Rev. Genet.,* 22:421.
(29) Christou (1995) *Euphytica,* v. 85, n. 1-3:13-27.
(30) Newell (2000)
(31) Griesbach (1987) *Plant Sci.* 50:69-77.
(32) Fromm et al. (1985) *Proc. Natl. Acad. Sci. USA* 82:5824.
(33) Paszkowski et al. (1984) *EMBO J.* 3:2717.
(34) Klein et al. (1987) *Nature* 327:773.
(35) Willmitzer, L. (1993) Transgenic Plants. In: iotechnology, A Multi-Volume Comprehensive treatise (H. J. Rehm, G. Reed, A. Püler, P. Stadler, eds., Vol. 2, 627-659, VCH Weinheim-New York-Basel-Cambridge).
(36) *Crit. Rev. Plant. Sci.* 4:1-46.
(37) Fromm et al. (1990) *Biotechnology* 8:833-844.
(38) Cho et al. (2000) *Planta* 210:195-204.
(39) Brootghaerts et al. (2005) *Nature* 433:629-633.
(40) Lincoln et al. (1998) *Plant Mol. Biol. Rep.* 16:1-4.
(41) Lacomme et al. (2001), "Genetically Engineered Viruses" (C. J. A. Ring and E. D. Blair, Eds). Pp. 59-99, BIOS Scientific Publishers, Ltd. Oxford, UK.
(42) Huh G H, Damsz B, Matsumoto T K, Reddy M P, Rus A M, Ibeas J I, Narasimhan M L, Bressan R A, Hasegawa P M, 2002, Salt causes ion disequilibrium-induced programmed cell death in yeast and plants. *Plant J* 29(5):649-59.
(43) Kang D K, Li X M, Ochi K, Horinouchi S, 1999, Possible involvement of cAMP in aerial mycelium formation and secondary metabolism in *Streptomyces griseus*. *Microbiology,* 145 (Pt 5):1161-72.
(44) Kerk D, Bulgrien J, Smith D W, Gribskov M, 2003, *Arabidopsis* proteins containing similarity to the universal stress protein domain of bacteria. *Plant Physiol.* 131(3): 1209-19.
(45) Zhu J K, 2001, Cell signaling under salt, water and cold stresses. *Curr Opin Plant Biol.* 4(5):401-6.
(46) Susstrunk U, Pidoux J, Taubert S, Ullmann A, Thompson C J, 1998, Pleiotropic effects of cAMP on germination, antibiotic biosynthesis and morphological development in *Streptomyces coelicolor. Mol Microbiol* 30(1):33-46.
(47) Davletova S, Schlauch K, Coutu J, Mittler R., 2005, The zinc-finger protein Zat12 plays a central role in reactive oxygen and abiotic stress signaling in *Arabidopsis. Plant Physiol* 139(2):847-56.

(48) Fowler S G, Cook D, Thomashow M F., 2005, Low temperature induction of *Arabidopsis* CBF1, 2, and 3 is gated by the circadian clock. *Plant Physiol* 137(3):961-8.
(49) Nachin L, Nannmark U, Nystom T (2005) Differential roles of the universal stress proteins of *Escherichia coli* in oxidative stress resistance, adhesion and motility *J Bacteriol* 187(18):6265-72.
(50) Rizhsky L, Davletova S, Liang H, Mittler R, 2004, The zinc finger protein Zat12 is required for cytosolic ascorbate peroxidase 1 expression during oxidative stress in *Arabidopsis*. *J Biol Chem.* 19; 279(12):11736-43.
(51) Vogel J T, Zarka D G, Van Buskirk H A, Fowler S G, Thomashow M F, 2005, Roles of the CBF2 and ZAT12 transcription factors in configuring the low temperature transcriptome of *Arabidopsis*. *Plant J.* 41(2): 195-211.
(52) Sanchez-Barrena M J, Martinez-Ripoll M, Zhu J K, Albert A., 2005, The structure of the *Arabidopsis thaliana* SOS3: molecular mechanism of sensing calcium for salt stress response *J Mol Biol.* 345(5):1253-64.
(53) Griffen, H. G, and Gasson, M. J. (1995) The Gene (aroK) Encoding Shikimate Kinase I from *E. Coli. DNA Seq.*, 5(3):195-197.
(54) Susstrunk et al. (1998) *Mol Microbiol,* 30(1):33-46
(55) Kang et al. (1999) *Microbiology,* 145:1161-72.
(56) Sauter M, Rzewuski G, Marwedel T, Lorbiecke R (2002) The novel ethylene-regulated gene OsUsp1 from rice encodes a member of a plant protein family related to prokaryotic universal stress proteins. *J Exp Bot* 53 (379): 2325-31.
(57) Kasuga et al. (1999) *Nature Biotech* 17: 287-291.
(58) Rus et al. (2001) PNAS 98:14150-14155.
(60) Shi et al. (2000) PNAS 97:6896-6901.
(61) Apse et al. (1999) Science 285:1256-1258.
(62) Zhang et al. (2001) PNAS 98:12832-12836.
(63) Berthomieu et al. (2003) EMBO J 22:2004-2014.
(64) Ren et al. (2005) Nat Genet. 37:1029-30
(65) Davletova et al (2005) Plant Physiol. 139:847-56

SEQUENCE LISTING (315 sequences)

SEQ ID NO: 1 - DNA, 1823 bp, Arabidopsis thaliana
  misc_feature: Ceres Promoter 21876
gtctcttaaaaaggatgaacaaacacgaaactggtggattatacaaatgtcgccttatacatatatcggttattggccaaaagagctattttaccttatggataatggtgctactatggttggagttggaggtgtagttcaggcttcaccttctggtttaagccctccaatgggtaatggtaaatttccggcaaaaggtcctttgagatcagccatgttttccaatgttgaggtcttatattccaagtatgagaaaggtaaaataaatgcgtttcctatagtggagttgctagatagtagtagatgttatgggctacgaattggtaagagagttcgattttggactagtccactcggatactttttcaattatggtggtcctggaggaatctcttgtggagtttgatatttgcgagtataatctttgaacttgtgtagattgtacccaaaaccgaaaacatatcctatataaatttcattatgagagtaaaattgtttgttttatgtatcatttctcaactgtgattgagttgactattgaaaacatatcttagataagtttcgttatgagagttaatgatgattgatgacatacacactcctttatgatggtgattcaacgttttggagaaaatttatttataatctctcataaattctccgttattagttgaataaaatcttaaatgtctcctttaaccatagcaaaccaacttaaaaatttagattttaaagttaagatggatattgtgattcaacgattaattatcgtaatgcatattgattatgtaaaataaaatctaactaccggaatttattcaataactccattgtgtgactgcatttaaatatatgttttatgtcccattaattaggctgtaatttcgatttatcaatttatatactagtattaatttaattccatagatttatcaaagccaactcatgacggctagggttttccgtcaccttttcgatcatcaagagagtttttttataaaaaaatttatacaattatacaatttcttaaccaaacaacacataattataagctatttaacatttcaaattgaaaaaaaaaatgtatgagaattttgtggatccatttttgtaattctttgttgggtaaattcacaaccaaaaaaatagaaaggcccaaaacgcgtaagggcaaattagtaaaagtagaaccacaaagagaaagcgaaaaccctagacacctcgtagctataagtaccctcgagtcgaccaggattagggtgcgctctcatatttctcacattttcgtagccgcaagactcctttcagattcttacttgcaggttagatattttctctctttagtgtctccgatcttcatcttcttatgattattgtagctgtttagggtttagattcttagttttagctctatattgactgtgattatcgcttattctttgctgttgttatactgcttttgattctctagctttagatccgtttactcgtcgatcaatattgttcctattgagtctgatgtataatcctctgattaattgatagcgtttagttttgatatcgtcttcgcatgttttttatcatgtcgatctgtatctgctctggttatagttgattctgatgtatttggttggtgatgttccttagatttgatatacctgttgtctcgtggtttgatatgatagctcaactggtgatatgtggttttgtttcagtggatctgtgtttgattatattgttgacgttttggttgttgtatggttgatggttgatgtatttttgttgattctgatgtttcgatttttgtttttgttttgacagct

SEQ ID NO: 2 - DNA, 1000 bp, Arabidopsis thaliana
  misc_feature: Ceres Promoter PT0668
atagagttttactatgcttttggaatctttcttctaatgtgccaactacagagaaatacatgtattaccactaggaatcggaccatatcatagatatcaggattagataactagttctcgtcgctatcacttcgcattaagttctagtaattgttaaagattctaattttttactaaacaaaaactaaatcaacatcaaatatgcaaagtgtgtgttgtccacacaagtgactcaaagtatacgcaggtgggattggaccatattattgcaaatcgtttccgaaccactcatatttctttttttctctcctttttttatccggagaattatggaaccacttcatttcaacttcaaaactaattttttggttcagtgatcaaatacaaaaaaaaaaaaaaagttatagatattaaatagaaaactattccaatcttaaaaatacaaatgaaaccataattttaatttatacaaaactatttaattagctaagggttgtcttaacgtttagaaaataaaaaattatgattgtctgtttaaaattacaatgaatgaataaaaaaaatatgcaatgaatgaaagaataaattttgtacatccgatagaatgagaaaatgaattttgtacaaaccactcaagaattcaaaacaattgtcaaagttttcttctcagccgtgtgtcctcctctcctagccgccacatctcacacactaatgctaaccacgcgatgtaaccgtaagcgctgagtttttgcatttcagatttcacttccaccaaacaaaactcgccacgtcatcaatacgaatcattccgtataaacgtctagattctttacagcctacaatgttctcttctttggtcggccattatttaacgctttgaacctaaatctagcccagccaacgaagaagacgaagcaaatccaaaccaaagttctccattttcgtagcttctttaagctttttcagtatcatagagacacttttttttttttgattagaa

SEQ ID NO: 3 - DNA, 1000 bp, Arabidopsis thaliana
  misc_feature: Ceres Promoter PT0535
ttagtgaaattatgacattaagtaaggttttcttagttagctaatgtatggctattcaattgttatgttaggctattttagttagtatatgaatttaggcagtctatgcaaatgatttcgttttcattttttcatatgtaaacatcaagatcaagtaacgccattcgagttgatattttttttttaaattagtgtgtgtaaattttggaccgcttatttgagtttgctaatgaagttgcatatatattacgttaaaccataggcaaactaatttgaaacatccgattcgatttcctgtaatttttcttggttaattgaccaaaatcaagatcttcagaaataaaataaaagacgaaagaaagctgtcgcaaagcagattgtgttaaaaaaaagtggattgggctcaaacgcaacttgtccagcccgtgacaattaccctatacgcaagtaagagtaacgtatcactggcaaaagttggtattagttacgatatctttgtcatgggggcatgcatgggcatggcttaagagttaagccttaagaagagtcccacactcgtgactctcatgatcacttgttgtttcttacgggcaaatacatttaactttattcttcatttattcacctatattcttttggataataacttttctctatataaaataacaaacatcgtacgtttcatttatttacaacaagcgatgagaattaaaaggagaccttaattgatgatactcttcttttctctcggttacaacgggattattacagataatgataatctatatggatgctgacgtggaaaaacaaaatttggtgaaacacgtcaattaagcacgacttttccatggctagtggctaagatcgtttcatcacatggctatatcatataatacttggatgaattcaaaataaacgactgagaaaatgtccacgtcacggcgcaccgctttggacttaagtctcctataataaatacaacaccaaacattgcattcca

SEQ ID NO: 4 - DNA, 999 bp, Arabidopsis thaliana
  misc_feature: Ceres Promoter PT0585
tgaagtcatttaatatgagtttgacattaggtaaacctaatctatgagattatagaatgtagcaaaactatcaatgtttcttttccaaaatattttgtggtttttctttttggttcattatgttttgttatttgtgaattattttaatatgaagtaattatattgattttatatgatatacatattattttgatataaaatttaacacttatccattaaaatagcatgggcataatcaaaatcgggactattacgatgaaaaagatagttaaattgtatgataaaataaaatgtgtaagattaaaattttgggttttagaaaattactaaacaaaatatagacaaagtatgttgactattatttaaaatttaaatatcatcaataagatatagttaaagtcattaagtgtatagcaaaatgaaaattctaagattaaaattcgattaaaattttttttactaaattaaatatttaaaaatagggattatcatttactatttacaattctaatatcatgggtaaaaattgataactttttttaaacccgcctatctaggtgggcctaacctagtttactaattactatatgattaacttattaccacttttacttcttcttttttggtcaaattactttattgttttttataaagtcaaattactctttgcattgtaaataatagtagtaactaaaatcttaaaacaaaatattcaacctttcccattattggaatggtaatgtcttcaacaccattgaccaacgttaaggaatgtcttttaatatttttggaacctaaatgctaatactgtataccacaatcacttatgagtattgaagttgagatagaggaggtacaaggagaccttatctgcagaagacaaaaagccatttttagcaaaactaaagaaagaaaaaagattgaaacacaaatatgcgccactcgtagtccacccctatctctttggcaaaagccacttcactctttttccctttttat

SEQ ID NO: 5 - DNA, 1000 bp, Arabidopsis thaliana
  misc_feature: Ceres Promoter PT0613
ttaatactaacattgtagaaagccacaaaaaagaaattgaaatgtgagtagatgctgagtcagaggtttggtcaatacacaacagctaattgagataatattatacacgtcacgatgacttgttttttctcctcccaacttgttaatttctttattcttaaaattaaaccatcgcaaaaacagaagaacacagctgtttttctcgactcccaatttctattttgctgctaaggacatttcatttcattatttcccaattcaggactccttagattttcctaaatttgttttcctaacttgctctctctcattctaacattttctcatttttttagattatcttgtactttttagtagattattttatcaggttttacaaacatacattgacattctaaaaagggcttctaaaaattcagtgtggaatgctgatatactaaaaaaaggtcatgcaaaattatctacgatttatctaaaattagataatttgccatatataactattaactaataatcgatcctttgattttttgtttagataaaacgaaacagctatatcttttttttttgttatcggattttaatcgaataaaagctgaaaaataacagttatatcttcttcttttttaactaatgaaacagttatatcttaaacaaacaacagaaacagtaaaatattaatgcaaatccgcgtcaagagataaattttaacaaactaataacaattgagataagattagcgcaaaagaaactctaattttagagcgtgtaaacacaaacacgtcttgaaagtaaacgtgaattacacgcttctaaaacgagcgtgagttttggttataacgaagatacggtgaagtgtgacacctttctacgttaatttcagtttgaggacacaactcaagttatgtttgatatctaaggacttgcactgtctccaaatctgcaggaaggactttttgattggatcaatataaataccatctccattctcgtctccttc

SEQ ID NO: 6 - DNA, 351 bp, Arabidopsis thaliana
  misc_feature: Ceres Promoter PT0625
gatcatgatcagtttcaactcgctgtgcccacgtgtcgagagatcggcacgtgcctgagctctcagccgctcataaatacacttgtttagtagcaacagtatactatagtagtcctctcctgtttggcttttagcttgcatcgatggatggatggatggatcgcatgagagggcttcgcgaaggtacggaaccttacacaacgcgtgtcctttctacgtggccatcgtgtaggcgtctcgccatgctacgtgtcccggaggatgtctcgatgccaacccttataaatactgttccattccaatcccatcgccacagccagtgcaaatctgatcgatcaagataatcgagca

SEQ ID NO: 7 - DNA, 1022 bp, Arabidopsis thaliana
  misc_feature: Ceres Promoter PT0633
cccgatcggccttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttcgttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagtttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctataaacttagtgagaccctcctctgttttactcacaaatatgcaaactagaaaacaatcatcaggaataaagggtttgattacttctattggaaagaaaaaaatctttggaaaaggcctgcaggg

SEQ ID NO: 8 - DNA, 1000 bp, Arabidopsis thaliana
  misc_feature: Ceres Promoter PT0650
catacttaattctaaaaaaacaacacttatagtttataagcagctcttatgataaaaatctttctgagttatagctctgttaaacttgtattcaccccaaaaacggatgtttcatttcttattttttacttggagtattttattgtaatttgtaaaaaaaaatgtaaagtgggggatatcatgaaaaacaacgtcactttgtttggtcacaatatacatttgataaaataatggtcgtcgcgtgatttagttgatttttgttttatcaaccacgtgtttcacttgatgagtagtttatatagttaacatgattcggccacttcagatttgggtttgcccacatatgacataccgacatagaaggttaaatccacgtgggaaatgccaatattcaatgtttggttttcaaaagagaatcatttctttatatgatctcaaaagtatggaattgaaatgactaatgagcacatgcaattggtgctatcttaaaaaccgaacgtctttgaatttaatttgtttttcaccaaaggtacctaatgaaaccctttcattaaaaaataaaggtaacaaacaaaattttgtattggaaaaaacattttttggaatatataatttggtaatagaattatgagcaaaaaagaaaaagaaaagaaagaataatgagcataataaagcctttacagtattactaattgggccgagcagttttgggctcttgatcatgtctagtaatcttaaacagacgataaagttaactgcaatttagttggttcaggtgagctaccaaatccaaaaatacgcagattaggttcaccgtaccggaacaaaccggatttatcaaaatccttaagttatacgaaatcacgcttttccttcgatttctccgctcttctccactcttcttctctgttctatcgcagacatttttgtttatatgcatacataataataatacactcttgtcaggatttttgattctctctttggttttctcggaaaa

SEQ ID NO: 9 - DNA, 998 bp, Arabidopsis thaliana
  misc_feature: Ceres Promoter PT0660
caagtcaagttccaatattctaaggagaaataatagtatactaaacatacattagagaggttaaacttctttttggatttaagtgtgtatgcataggctatttattcttaagtataactattaactgtagctagatttatacaagaaatacataaaactttatgcatgtgaggtagccatgaatatacgtacatgttgcaatcgattatacatgttgtatttggatttctctatacatgttttaacttgtcattctctaagtatatacataccattaatactgtgggcatgagtttatgataagacttttcttttggagaccagttttgttttcctttccacctatatttgtctataggcttcacggtacactagtttacaagtgtttttatatgttctaaataaaattgagattttccggaacggtatgatctgtttgcaaataaggacgtatatataacagtatcaaatatatttgttgttataaggcaataatatattttctgagatattgcgtgttacaaaaaagaaatatttgttaagaaaaaaaaagatggtcgaaaaaggggagtaggtgggggcggtcggcttttgattagtaataaaagaaaccacacgagtgacctaccgattcgactcaacgagtctaccgagctaacacagattcaactcgctcgagcttcgttttatgacaagttggtttttttttttttttttaattttttcatcttcttgggtttggttgggtcactcttcaggtcaggtgtgtaaaaaagaaagaaagaaaagagagattgttgtgttgtaacccctttgactaaaatctaatgaacttttttaacacaacaaaactccttcagatctgaaagggttcttcttctctcttagtctcttcgtccttttattctccgtcgtcgtttcatgatctgactctctggtcttctcttcttcttcttcttcttctattttttcttacttcgtcactgttgtgtctgaac

SEQ ID NO: 10 - DNA, 1000 bp, Arabidopsis thaliana
  misc_feature: Ceres Promoter PT0665
aaaaaggatgggtaatgggacctattttccccaacatcccacatgcacacttccctctccattctctcacatttatttctttcattctaatttatccattccgtgtgtaacatattcactaataatctcatctcactaactcattcattgattgtgatatgtttatctagaattagtgttttaacactgtgtctacatatgatttccttttcattgtatgtgaacatgttaactcactaatcattttgtattttcgagttaacatgagtctccacttcggtagactaaagtaaagataggtttgagtataataaagtttaaaatttgctttaaaatcaatatttataaataagtttttatcataagtgatttttgtatgttatattggaccttgtataaacagactacagaagaaaattatttatgagaacttgtaatgttagagtggacctcgtataaactaattatgtgggcttttaccataaactatttatgaaaattattatggcccacaccactataactaaagcccacatatttagcagcccagtttcattgtaagagacatgttcgctctggaactagaattttctggtttttgggtatttgttttcttatgtgtagagaaatgatggtaacgattaaatgttgtgtattacaatttacaatggtaagacgattaatatatttacacacaattttgttgttgctgtaacacgttagtgtgtgtgatgatagaatttcataaagctttaactacgaggggcaaaatgttaattctaaatagttgacagcagaaaaagatatgtatacataatataaggattaaaacgtaaataataataaataaggcgagttaaattaaaaccctgttaaaaccctagcttgaaacacatgtataaaaacacttgcgagcgcagcttcatcgccatcgccattctctctctcatcaaaagcttttctccttgattttcgcattctttagagtcttaacgcaaag

SEQ ID NO: 11 - DNA, 999 bp, Arabidopsis thaliana
  misc_feature: Ceres Promoter PT0672
cagccgtaaatcctccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa

SEQ ID NO: 12 - DNA, 1000 bp, Arabidopsis thaliana
  misc_feature: Ceres Promoter PT0676
aagatagtacagtttcagtgttttgagaaaaaaagctgaactaaaactaaaatgtttaaggacacaatatttagtttcaattagataattcaacagtttgaacaattttttttttttttttttgaagtcatttatttatacaatgttttaaaacgcattaagcatttaggcagccgacaaacgcctattgtctaactgtaaataggcgcttccacttaggttcatattgcatatttactatatgtgtatagtgacaaaaaccaatatttctcttattttggatgaaggtatagtagttgttaaatgttcaatataattaagcattaatgacaaataaaataaaattaatttagttgataaaaagataatcttataaaaagatcgatgaatagatataatggtttactgaattctatagctcttaccttgcacgactatgtcccaaggagaggaagtaccttaactataattctgaacataattttgtctatcttggtgagtattatatgacctaaaccctttaataagaaaaagtataatactggcgtaacgtaataaattaacacaatcataagttgttgacaagcaaaaaaacatacataatttgtttaatgagatatattagttatagttcttatgtcaaagtacaattatgcctaccaaaattaattaatgatttcaacaggaagtctgagatgatgggccgacgtgtagttacgtttcttgaattgtgagagatggtatttattatactgaagaaaacattatttactaaataaattttcatttcacatcttctgtaatcaatgcgggtagatgaagaagttgttaatacgatggccaaccatatggatctcttttttggcgtttctatatatagtaacctcgactccaaaggcattacgtgactcaataaaatcaagtcttttgtttccttttatccaaaaaaaaaaaaaagtcttgtgtttctcttaggttggttgagaatcatttcatttca

SEQ ID NO: 13 - DNA, 998 bp, Arabidopsis thaliana
  misc_feature: Ceres Promoter PT0678
aattaaatgaaaccgcccctaaattaggagggatttgggtaagtggtaacacattcactggaaacatgtgaagaaaggaggatgtcaagtagctgaaaactcagtatagtaaccaacggcttctcaccaacctttcattaataatttggtcatccctatatttttattcaacattttgtttttcaatagcttagagcaccttaatacctttcagtgtttttttataaaaaaaacaaaaattgggattaatcatcaatccccaaatgtaacgtttacttagattatgttcatttttctatacacacaaatcatattcttttgttttaatcttcgaaaaacgagaggacattaaatacccctaaaaaaggaggggacattactaccaacgtacattaacatgtttgatagcaaacgatttattttgttcgttttgaaaaggggaaagtaatgtgtaaattatgtaaagattaataaacttttatggtatagtaacattttcgaataataagagagggaaaacactcgccattgtcggcaatttagaaccaatattagaagggtttttttagagaaaaaggacttaaaagtttagagaccttaacaacaacttatttagaaatagacatgcttaagttgacaacagcgagtttattttctatatcgaagaaaaatacgaactttttcttaattagatttcgaatgcatgcactatcgagaatcgaccgtcacaagaaaaaactaatatacatactgtacatatctatattcaatattggtggggatgggtttaatgtgtatttataattcatggataaattcacacaataaggtccatgaaactagaaggtaccaaaaataagcattaatgactctttgccacttatatatatgattctctcatagtaccattttattctcccaaacctatcttcttcttcctctcttgtctctctcgctctctctcttctacattgtttcttgaggtcaatctattaaaa

SEQ ID NO: 14 - DNA, 1000 bp, Arabidopsis thaliana
  misc_feature: Ceres Promoter PT0683
gattgaatgatgagtgtgcacccttgtattactaataaaaaatttagcaacagttataagctaacgtcatccatgagtcattcattagattcactatttgcgttctcaaaaatcgaattgttaaaatttgagaagctctaatatacgagtcaatgagatgtggcaaaagcatgtccttgaccataaaatttcgaggggtcaactcattagataaggacaagaatcaaccaattgaaggcgtcttctataacaagtttctttattactaatattaaagtccaatggggtgagggggagaagaacttaaataaaaggaaataattggtaagtgaataaaatctaaatacgatactagatgattgatttgtgctagtgcatggtattagatcagatatgtgttactattcgaattcaaattggcatattccatgttgttgataagaaaattgtagaagtgtaaaagctgagttactatattcaaactagtggtttacataaagtgagacaacaactgtttcacaaaaatgactataaaatagtaagtagtattaggtcaattgattttaaaattttaatcaaattcaaatttgtgatataatcaaatttgtttatagaaaatgttaagaaatcaattttggcagaactaattcagtgagaaacaatcatttacaaaaacaattttaacattatttaacagtaagatttgacatttaacccgttcgtgtgaacccatcatatctaacatggctctacccatgacgcctccatgccatggacaattttgacagatcagaagttctgaacgtggacgaggtaagaacaccatgatgatacgattggagttagttatgtcgccaccgacatcactgccaatctcattaataaaagtggtactaaatctctaatctctattaactataaatataacaaagaaccaaaagaaagtttcttatctctcttatctttcataatttccaagaaacacaaaccttttctacta

SEQ ID NO: 15 - DNA, 1000 bp, Arabidopsis thaliana
  misc_feature: Ceres Promoter PT0688
acgttcagaggcatcgcttttgtacaaattgaagcgggtttgttcaatatttaaaataacacaggaaacattcaaatgtattattgatgttgcttaggtttgtgaaatgatatgaaccatatcgtatatattactagatttttcttatatgttttaagggtagtggggctgacctatcattctgtttggcattaccaatcagactatcagagtattcaccattcaggattccataactagaaaaagaaggggtttacattttctcatactgtataattttctactatcagagattttatcgattacattaatctcatagtgattattctgatttataaaaaagttgacaaaataattaaaaccagtattttataacaagattgtctctctcccatggccattattttgacctctgacttatttaaatcttaattaacagcataatactgtattaagcgtatttaaatgaaacaaaataaaagaaaaaaagaacaaaacgaaagagtggaccacatgcgtgtcaagaaaggccggtcgttaccgttaaggtgtgtcgaactgtgattgggccacgttaacggcgtatccaaaagaaagaaagggcacgtgtatagatctaggaaaaaagaaagaatggacggtttagattgtatctaggtaccaggaaatggaacgtcacaccaaacggtacgtgtcggatcctgcccgttgatgctgacggtcagcaacttccccttattcatgcccccctgcccgttaattacgtgtaacccttccatgcgaaaatcaaacccttttttttttttgcgttcttcttcaacttttctttttaaatcaaaccttttctttttaaaatcacattgcatttcctaacgctcaacaaaatctctctctactaatatctctctctctctctctctattgttgaagaagactcataatcggagattgtttgtttttggtttgctctgtaaattggagaagttttgttagagatcaa

SEQ ID NO: 16 - DNA, 1000 bp, Arabidopsis thaliana
  misc_feature: Ceres Promoter PT0695
aacattttctttaacttactcttaaattttaatagtaagttgatgcatgttatgttgatccgtcttgatcacaaatattgttttatggacgaattctttgacagtaaatggctatagtgactcagcttggagcatcccgatatgaaaacaaagtgcagtattgtgtcgtggtcatcactaacgcactttcctagaactatcgcgcgtgtttgacctatgcaacacaccagatgtcatgaacgtatacttaaatagaaacaatgatatagacaattggctatattctgtcatggaacgcaaaccggataacatgtctattagattcatcggacttgatcatggttatgtcttaatagacgaattctttgttaacgattggttaaaacggctcacgttagagcatcctactatgacttcaaaattgataaatattacatggaaatcactttaattttagttagaaggtagttaatttagatattcttatttaataaattaaaaaatagaagaaaaaaagatgagaagagtttttgtttataaaataagaaatatcttttattgtaattttaaaattaaacaaatttaatttatattaaaattatctttgttttattgttaaggcaataattatttttttggtgggaattgttaaaacaataattagtatactgttaagtggtcctttaataataagataacgtgatttaaaaaagaacgagacaggctaatatagtagagaggaaaaaatacaatttaggcccaataaagcccaatatagagttgtgctcaaacacaggtcttcgccagatttcctatgacgccgtgtgtcaatcatgacgccaagtgtcattcaagaccgtcacgtggcgttgtttctacacataggcgatccatacaaatcagtaacaaacacgaaaagagcattcatatgtacgaaagtagaaaagaagagactctttgtgataaaactaagtaagaaatagcataaaagtaaaaggga

SEQ ID NO: 17 - DNA, 1000 bp, Arabidopsis thaliana
  misc_feature: Ceres Promoter PT0708
gtttccaaaactagtattctttatttgctctattcattatatttttatatttgtaacgtcccgaccgtctttattaggtttcgacaatcacttctcggaaggtcgtccatcctgaaattactctatcctaaacatgtttaactataaaattctctcgaaacttttgtaacgtatataaccacataaattctcttaaacttatttgcatacaccattatatttctgaaatcgatatgttacaatattatttaatatttagattacttttactgaatcgaattaaatatcaaatcgaaacaaatctaatctaccaaaaataattttgttataaacatttcttgcctagttctacctcatatacattttagttaaagaaagaaatcacaacaattcccataattcaataattaaatccacaaaatcttggagtaagtaagagaaataaaaagatagtatcttaacataaacaattcaaagatgctctctcacacaattcacacacacttacaaaacaaaagacagaaacaatgttttcattcaaatcaaaagaagttataacactagtacaaaaaaagctcaaattctaatagtaactctttttatttcccaattacccaaagattctctctcacttcacaaaactagctttgagagtcgtgttccacaaaatccattaaagctgaaacggttttgctcaccattcaaacaaatacaaaattgcaaaaccccaaattataacaaaataatataaaaattaaaccgctaaaaagagtgaaccaacaaaaatcgccgaatgtgtgtgtaatgagaaaaccgacccatcatcccaatcatctcttcccgtgtcactctcttcctctcccacgtttcttctctcttccctttatgggttttaacttctccttcttcttcttcttcaatcttcagttttcaaattcaacaacaattcacattttgatttcttcatcatctctctctctctcgcttctctctcaaatcg

SEQ ID NO: 18 - DNA, 1000 bp, Arabidopsis thaliana
  misc_feature: Ceres Promoter PT0710
tagtgcgcgtggggagagggaatggtgaaaccttagtggttaagttatgaggaaaatgataaaaggataaaacaatcaaatgcagcttgaaacggccataacataaagtaccttatggtggtgcgaatatttttgtgtttctttcactcttttattgctgaaagctacgacacttgtcttaatatattgtttccgcaagtcacatgatctactttttatttaacgtctagaaacgccgagatatatgatgattagtatatcacgtctatgcaaattgttagttcgtgtttggccaaaagatatcgagacatgtctgaagaaccgagtctggttttgagatatttcttcaagcattactatacaatagaaaaaggagacacgcgaatatgataatagcaaaaggcataaaaaggcgaaaattaaagaaaaacgtaaagtgatttggcctcaatcaacgggaacgtatcttaattttagaggttcttcttttacttttgagacgagagagtttgcgtctttgcgagctgctttggttgactaaacattatcatattgaaaaccaaaatacaacggaggaatatttgtcacagtttcactttcacattgtttccttaacgtttaatcaaccttgttcaaaatttctatagttgtaatcatcattgtttacaaaattttcgttcaaagatgattttaaataaaattgtgaaagaaaaccttttctgaaataaggattggatgatagtgttaaaagaaaaatatgaactgaggcaaaaagaggagtggtccccggaagattgtgaaatgtgtcatctaaaccagccagacgtagtcacgtgttctctctagctttatgaacttccttagccagcaccatcattgtgattgtagtatatatgtaaccctaccttcatctctcccattttccattctccatatagactcctttacaatatacaaaacctatccaaaagcgaagaagccaagcaaacatattataaaa

SEQ ID NO: 19 - DNA, 1002 bp, Arabidopsis thaliana
  misc_feature: Ceres Promoter PT0723
gtcatatcttatcaacacgtcaacgatcaaaacctttagcctattaaattcaacggcttagatcaaaacgaaactaggtgggtcccacttttaatatcgtggctgcataacatttcctcgataactgaagccgttgtggtctttctcagaatctggtgcttaaacactctggtgagttctagtacttctgctatgatcgatctcattaccatttcttaaatttctctccctaaatattccgagttcttgatttttgataacttcaggttttctctttttgataaatctggtctttccatttttttttttttgtggttaatttagtttcctatgttcttcgattgtattatgcatgatctgtgtttggattctgttagattatgttattggtgaatatgtatgtgtttttgcatgtctggttttggtcttaaaaatgttcaaatctgatgatttgattgaagcttttttagtgttggtttgattcttctcaaaactactgttaatttactatcatgttttccaactttgattcatgatgacacttttgttctgctttgttataaaattttggttggtttgattttgtaattatagtgtaattttgttaggaatgaacatgttttaatactctgttttrcgatttgtcacacattcgaattattaatcgataatttaactgaaaattcatggttctagatcttgttgtcatcagattatttgtttcgataattcatcaaatatgtagtccttttgctgatttgcgactgtttcattttttctcaaaattgttttttgttaagtttatctaacagttatcgttgtcaaaagtctctttcattttgcaaaatcttctttttttttttgtttgtaactttgttttttaagctacacatttagtctgtaaaatagcatcgaggaacagttgtcttagtagacttgcatgttcttgtaacttctatttgtttcagtttgttgatgactgctttgattttgtaggtcaaa

SEQ ID NO: 20 - DNA, 1001 bp, Arabidopsis thaliana
  misc_feature: Ceres Promoter PT0740
tgtggccactaaagatttacccttaaccgggcccatataagcccacgtcaagtggcgcttatacgctctccgtaagagagccaacatttggtatgtaatgttgcaaattattcttcaagacaataaattcaaatataattcaatattgtccaaatatagtgatgtacttcagttgtgcacatagaaactccactaaaccaacttttagatagatgcattcacaaattttcaacaatgtcgcgaaagtctaatccatcaccagattctaacattttaattattatatttaactatacatactctaatcagcatgagtcaaacgtgtacaatagcccaagcatataataagaccaaagtcaaactcaaataaatgtctccaaactcaaaacttgaaaaagacctaattattacatggtagatatgactttgtcgacaagtaaaccaactaatcctcgaagctaccttctcttcccagttattatgtgtgatcgatttataaatctcttcttctaataacacctatatttttcttatgatgtgaataaatataaaacttttaactttaaaacatatttatccgaaatattgcacttagatttcaaatagataaataatagtactatctaactgatattgaaaagacctaacacggaaaacagttttataaaaaatcccaaatgtgggtaattatcttgatttcttgggggaaacagaaaatggattaagattaatcggagtcgtgtcaagcagctcgttaataactgtagcaagttgactgagtaagcatcaacgtgtcatctccgtaaagcccattatttctagtctcgccgcgtcttctcttccacgtagcacttcactttttctctccttttgtttcctttggaacacaaacgtttctatttataggaataattacgtcgtccgtatctgtgtcggaacatagatccaaattaaaagcgacttacttaattacatatcgttcgtgtttttttcttcaaaaa

SEQ ID NO: 21 - DNA, 1024 bp, Arabidopsis thaliana
  misc_feature: Ceres Promoter PT0743
tcgattggcccgatcggccccaaaatcaagctgagccgcttcaaacttcagcttttgaaatcacccccaaactcatgtcctcttatcattataactaaaggatctttcattttatttaactcatcgtcttgcactacccaacccaaaggttccaactatacccgaagctttctaaaggtccaaagactttttttttcgagccagactattcaagccaagaaaagccaaaccccacaagccagtacttttcaattccatattataaacttatctgtcttgttttagtcccactaaaaacaacagaatttaatttaggttgagctaaaacccttgacaaaagtgtatagtcgtcgattcagtagcacactcatcactcatcagatttgatagttgacctaaagtatgactactccatttcaactaacaaatgaaaataaaagagacctaagggttagaggattgaaactatactctcaagtcttttatcactaggctactaccagctagttaacttgatggatttaagcaagaaaacgtagaatttatattcgagcagattgtttagctaaaaaagcttgggtttgaaattgccttttctcccatataagcacgtcggttcctaaataactctttctagcggagagtgtctttccaataatttaataaaaatggtgtttgtatatcaaaaaaaaaagaaaaaagaaactgatcgagatagaacgtttgcagttttataaacaatttaaaaaacaaaaaaaattaaactcaatgtattttttattaattcacaaacaataataaatcataggatcgaatatttacacggtatcaaaacctactcgccgctactatataaaaattgaagtcaaatatcaaccgcaattattaaaccagcaagacaataattcataaacttaatataaacataaataaattaatgttacacaacgatatatggtgagggttattactatcttcttcctctcaaaacacatctcctaaccttaagctttagacggcctgc

SEQ ID NO: 22 - DNA, 1000 bp, Arabidopsis thaliana
  misc_feature: Ceres Promoter PT0758
agctagccacatcagtgaccaaaaaagataattaacaaaccaaataaaataacaaattttgatcatttggaataaaatttataaaaggaacgaaagcgccttctcacgggtcccatccattgaaatatattctctctttttgctctatataataataacgcgtactaatttgtagtatatattattacaaagtcgatatttgattgttttgtgaacgttgatatattaattttcttggatgatgacaaaaaaagtcatagaaagtaacgtgtgaacatagcattaacaaaatacaaacataatatataaccaaatatatgaaaataggataaaatctcattgaatagatcttcttctattcaaatatataaatatttgtttgtctataaaattaacagagcattcacattatctaaaataatagtaaaatcaaaataaaactaaataaaaataactctggttttataacgattgattttaaatattagtttttgttgtaaagagatcattatatatgtctgtaatatttttatactgagttacatgatatttagttattatagcgtaattaactaagataagaaattaactaaagtgatattctgattattattatttttgttaggacacgtacgtggaaaaactaaacactataggttacaaaacggtataataaactcaccattactggaaaatgtttgcatttgactcaataagtaacttattataagttactgatataatgcatagttttgaaattcttaaataaattattttggtttcgcatgaaaatatgaaaggagagaaatttattattgtcacttatatatatatacatcgtaatcattttttcgtgaataattctctctcccattccattatttctcagtatctctctttctttcccttactttattgttgcttttaaaccttcaatttgctcataaaccaaatatataatatcaaaacaaacaaacaaaaaatcagaattcccctaata

SEQ ID NO: 23 - DNA, 921 bp, Arabidopsis thaliana
  misc_feature: Ceres Promoter PT0829
aaagttttgaattattgggaatcaatttcgaagttttgtaattctttgggggctaataggatattttattttcttggtttcgtctattgttgtttttctatttatggttgggcttttagaactctggacaggcccatgtcatatgttttcccttctccttatatttttcatttttcattttgttaaattaatgcataatatccaaaaacaatttaaatttttgaaggaaccctttagttacggctccgaagctttcacaagtgagaatgtgagatcaaagaaggcaaatggaggattttaaaagttaaaatcatcttttatctgcaaaagttgacaatttttttgtatcaaatctaaatcatcaaactctcttaaactacaagagcataacaacctctatgtaatccatgaaataatctgcttgaaggacataacataaatcattatggctagagtgactaacttcaatcaaatcctcttaactctagctcccttacaatggtatcgtaaaacattatgcattagggattgttgtcctaggaaaataaaataaaaatccccacagaccaactaccattttaacttaaaaataagcttcgtccgcgacgaattgttttccatcctaaaaatagaatggtgtaatctgctaatggtttagttccattaacttgcaagttctattgaaagcctaaatgtcaataaagatattaaaattcggagtcaaaagacaaatgaatcaaaagcaacaagacaagtcagctccattcttcactacccatcttttacaataaatcatctctcttttcacaaatttcaaactactctcattgccctttagctttgttatagagccaacactacagagagactcacacacttgtttcaataattaaatctgaatttggctcttcttataaacta

SEQ ID NO: 24 - DNA, 763 bp, Arabidopsis thaliana
  misc_feature: Ceres Promoter PT0837
aactacaagggagacataatatcaccatctggttcctgttatcatctgaagatttcttgttttaccttccagtgataaaatgatccttataatacatatagatatattaaattgctgtattttaagattatagatatataaggtacatgagagtgtttatttaaaaaaattcacttggaattcatgttttgtgatacgttagattggaatccatttgggaaaagaagaatcatctgttcttatgtctcaaattttgacttcattcacttttcttcttgtcttttaagaaagcttccacaatctaactgttcgatgtgaaaactgagattcgagtaagaaaatgtgaactgtgttatactgttttttaattagataatttagattgcactcagataaattaataacattcctcgaatacttttatgtgattggatatattaggtatatctgccaaccaaccaataaactgctatgtttaaacaaattaaataaattagtatatgtttactcaagaataaagaagatagaaaagaaaattctatatgagctaaatttgctggaggaggcatcggacgtgggtaccagacctttccaagcacacgagtagtgcttagccatgtcatgctaacatacaccatttggttcatacaaaatccaaatcaaaatctatttttaaaatcttttgcacacgtctttgaaaaacacctctcatactatagctacggaagcttcaatttcaaggtttgtctaaaagctaacgatt

SEQ ID NO: 25 - DNA, 751 bp, Arabidopsis thaliana
  misc_feature: Ceres Promoter PT0838
atactggtatgcttaaggttgaagccaagatctctgtcttacccaagtaaccactttctattagaagggatcaacactaagaatatggagatttaagcctaagggctaaggcggttctcaacaatacatgatgtgaatacaatcacagacgatttactgaggtttgttgataagatcttgatcagtctctgcatcatctgttcaacaatctcaatctttgactgtttgctttcggagccataaacagaggaatcccttattccctgttataggagcaatacaccaagtattatttccatggctgaaattctcttatggaaacctaattgttccattgaagctgtaaaatcgaatctggtgaatattctcgagcaaagccgcatgctaattatgtcaattcagaagagtttgattaggagactcgaagcgagtttgatgatctttcttgatgttcaactccgattgtaagggtataattgacttttcatgtattacggctccaccacctgacactaaggcactctttgtccatctcgttggtatcatcggattcggatggtaaaaataaaaagagcagaggaaacttgttactcatgcaagcttctcaggtgccacgtcactccattacgtgtcatcttcacacaccatctcgctcaaaaccgatctcatttttcaaaccttaaaggcagaagcaactgattaagttaacactcttgagaagctctcgattaagcttgaacttggaggatca

SEQ ID NO: 26 - DNA, 669 bp, Arabidopsis thaliana
  misc_feature: Ceres Promoter PT0848
tctctttaaatcagttaactaaccgtttatatatttacgataaggtttgaagagattattgataaaataatacatttcataatcccgcgttcaaccgtttaaagtaacatttaagttgactatatctaattttttttccattaaatatggagctggtaaactttatcaacttctaaaaagtgtaacaacaaaaattaggtcaatcacaattctgttttttttattattttggattgacttccaattgcaaatagtcttagtgatcaccattatcatacatatatacatcaagtaggtttcatcatgatataccacaaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagcttttaaaaatatttcaaaacaagcctctttgtgtttgtctatatatatacacgtaataagaaggtgaatgaatctcacagcttacttgttctaaggcttccaataacgaaaacagta

SEQ ID NO: 27 - DNA, 702 bp, Arabidopsis thaliana
  misc_feature: Ceres Promoter PT0863
cgggaaacgacaatctgatctctagtccagtcgattggcccgatcggccgattataaacttacatgagacaagtataaataattattataaacttattaagtttaagatcaaggcttttgtgcaatgtatcaatgaatgttagatgtgatatgatgaaagcaatgttttaaacacatacatagtcattgatcggaatgtgtgttattagaaatgcatgcctaagccgatagggttatctatgtttggtcttggacattatagccaaatttcgaatctaattcttccaatatatatttttttttttttgcttagggccactactagtattgcttatcaattttaagagctcatgaaaatgcaacaatatagtagttgcaaatccttgtttcaagagaaatcaaagggccacttgtgaattgaataataataatatttgcaaataacctttcactaaaccataccaacaaaaccacacagatttggcaaagacataacctttgggagacgtgaaaaggctcaaaatttgacaattgtccttacaaattcgctcattagtgcaattgtgagatttgtttgcatccaaatccaattcataactcacactcgtctcaaattcgaaaaggcctgcagggccagtgcactgggatccaacaatgtcctccgactcgtccaagatcaagaggaagcggaaccgcaccgcg

SEQ ID NO: 28 - DNA, 435 bp, Arabidopsis thaliana
  misc_feature: Ceres Promoter PT0879
ttctaggaagactggtcaagctaagctgtttctgttttttgtttttgtactttactttttgtttgctagtgggaactgggtttattgggccttgaagttgataaaagatgaataaaagacatatcgcctaaagcccatatgagaagcagaagacaaaaacctccaactttgggcataaattttgattatagttaaaagtccagacccaatttggcacctggcttagttacgattctaaggcatgacacctgcctaatatgtttattacagaaaataaagagaatcagctaggtgtcccttattgaacacattaacaaactccaacgacactacgtgtcttcgtgactcttactatatccaaaaacctatagctaaagctgaattttccatgattagtatagtcccaaccaaaaaaatactgaagaaggcataagc

SEQ ID NO: 29 - DNA, 397 bp, Arabidopsis thaliana
  misc_feature: Ceres Promoter PT0886
agtgtatttgaaaacgacattgaagaattaatatatttttttttaattttagttttttatagtacaaatattaaaacaaacaatcctaccatatcataacatttgtaaataacattttaagttttgttttgagttttaattaattttctatgacaaaaaaatgaagtcaatagactaagtgaatcatatagtataaataaacacaatttaaatagtttcaaataaatttagaaagaataaaacaaatagaaatcagaaggtgtctgtttcctcctcgcaacatacgatcaaagagaaacaacttgaccctttacattgctcaagagctcatctcttccctctacaaaaatggccgcacgtctccaaccttctcccaactccttcttccgccatcatc

SEQ ID NO: 30 - DNA, 1024 bp, Arabidopsis thaliana
  misc_feature: Ceres Promoter YP0007
agcagaacaactatatttattgtgtcacataaatctgagatcatttataaccaccaaagaacctatacacagtaaatgacaaatgtatctccctctatctctattgcccatatgtagatgctaaagtaagatttctcttttttttaatgtacttttttttgtataaagtatattccataagaaaaaggaaaagcttgtttatggatcaattgaccccaaaaaaagtttttagatcaaagcccaatataaaaaaaaaacacagtagtgacacaaaggaacttaaataaaccatgaattgatctataaacagtagagatcgataaggcgaacattttccatgtgaagtgtcttctttcatctataatatttttgacatccaataatttcctctataatatcattcacataattgatagaaacattatgttagaattgtccacatcatttgagctgtaatatattctgttttaacaaattatatggtagttgcttaatcttatgtccatcttcttctatgcatcgttttcgcgcctagttgtccagtccatttcaactacctacctctaattcttatcttaaaacaacattttttaatttaagtattatgctcaaagactaactagatagaaaaccgttattaaacattaaacgaattaaaagtcttacatggaaaatgtaggtttataaaccacgagttatgattgacaataaaaaaaatgcaaatcatcaatcaaaagagacttgagtgcgactctatatcaaccattgcaattaaaattatctatcacaaaaattttagacagattaagttaatttagtctaaattcactaatttattttctataattagtaattaactatatttatttatttacacattttctgataatttagaaatttgcatgaataacaaatataagattttggaaattagtagcaaatttaattaataattatttttgcctaaatgaaccaaactataaaacctccacatacaccagtcatcaaatttacagagacaaca

SEQ ID NO: 31 - DNA, 1000 bp, Arabidopsis thaliana
  misc_feature: Ceres Promoter YP0008
ctcgagagatgaagtcttagtaatgtttgaacaaacaataatcacgttttccatcaaattcgagcatttaaagtttatattactacatgccccaagatgataccgtccatctcatccgaaaatatttctgaaattgcgctaagacaacaatgtttgctcaaattcgatcatttaaagtttacaaatctctcatcaatcttacaaacttctcacactaaacagaggtacatattttcttataaagacaaaaggttcgaacagctggcttctcaactcgagttgtttgtcagggcctctcttcactaactacaagttggtacttcaaatattggtggctagcttcacgtgatattgtctacaaattaaacccatgaaaaagctgcattaattgttccaagtgaaccctgaggagtgtcaatagtctttgctttagtgtgatcattaaaccaaatctctaaattcctaatttgtactaacatttggaacgtatttcctactcttctccctgctccaactcccaaaaataagattagttagatttctataactaatatacatgtatactcccaaaaacagtaaaaccatattaataaagctaattttgcatagatttatttcggtaaaccggcggttcaagttggggaaaaaaaagacaaacggtctaaagtcatccaaagacaaaaaaccaaagacaagttgagagagacgagaccaatcacaacattgcttcgtagattgcgtgacatcatccttgacggctactttcatttgtgtcttatttggataaaacgcacgtgtttaattcacgaaccttcatagcaataagaaatttccattactttcatattttcaactttttttattacccattacatgcttaaaatattaattcacaagtctttgtcaaaattcaatattttccaggttcatgaaccctttttatctcaatctactctataatatctccctataaattacaacaaaacctctttatttttca

SEQ ID NO: 32 - DNA, 999 bp, Arabidopsis thaliana
  misc_feature: Ceres Promoter YP0019
gatataagtagaatcattttttgccgccgtttctcgctaacacaccgaaaactgaatcaaatctcctagctcttctacgcaaaatcgagtgcatcgacaatggcggaacgtggtgtcgaacgtggtggagatcgcggcgatttcggacgtggattcggtggtcgcggcggtggaagaggtggtccgagaggtcgtggtcgccgtgcaggtcgtgctccagaggaggagaaatgggtgccagtgactaagcttggtcgtctcgtaaaggaaggtaagatcacaaagattgagcagatctacctccattctctcccagtcaaggagtaccagatcatagatttactcgtcggtccttcattgaaagacgaagtgatgaaaatcatgccggttcaaaaacaaaccagagccggtcagagaacgagattcaaggccttcatcgtcgtcggagatagtaacggtcacgtcggattaggagtcaaatgctccaaggaagttgcgacggcgatcagaggcgcgatcattctcgcgaaattgtctgtggttccgatacgaagaggttattggggtaacaagattggaaaaccacatacggttccgtgtaaggtaaccgggaaatgtggatctgttactgtacgtatggttccagctccgagaggttctggtattgtggcggctagagttcctaagaaggttcttcaattcgctggaattgatgatgtctttacttcttctagaggatccaccaaaactcttggaaacttcgtcaaggtatgtactttcacaatggctgttttggtttgatgaactctgaattaggcagtgaaaaagtaatcattaccagttaagtgaatttatattgaagattaggatttagctgattgtattggtttgagcatgtgagtttgtgtttaagattgcttgaattgaaatgctttaggttgtttgattacgctaaattctgactaatgtaattcaaattgttgttgtttttttttggtc

SEQ ID NO: 33 - DNA, 1024 bp, Arabidopsis thaliana
  misc_feature: Ceres Promoter YP0028
gtcagtgaagtcgattggtagtacttgaaacacttggttggtttcatgtatttggcctatatataaacaaacatcgtaattatatacggatttttttcggaattttacgccatatctgtaagtatatataacatgcatgtcgttttcaaattcatatgatgaacgatccacgtaagtgctactactcctacaatattgcatgagagagatatgtatttataaattttattttgaagaagaaataagagggaaggttacttgggtggatcgatgtgaaaacaaaagaagaaaaagcgaaacccactaagccattacatgatatcgaccttcttatctttttcctctttattttatttttctcatcttctttttgtcaggacttttttctacttaatgaaacctccaaactatctaactaatacactcccatgtagaataaagaaaattatataagatattgttgatattttgtaactagaaaatatatttgctctgtaatttttcgtaagttaaatcaacattttaaagtagaaacaaatattactgcaaaaagtaggatcattatttttgtccaaaatctcagttagctatagggttgtagtaaaaacaaaacacattcttgatttgccccaaaaaataaagagagagaagaatattgttcaaaagtggtctcttctctctctaattatgttttcactaaacccaattagattcaaacagtctacaaagtccaaaagataaacatgggacaacaattcgatgcaaaaaatcctcttttcatgctctttttttattctctagtcttttaaattactaataaaaactcacaaatccaccaaacccattctctacaactcaccttcatctagatttacccactcccaccgagaaacacaagaaaaaaaatatacatatataaatatacaagacaacacatgatgctgatgcaatatacacaacaaagtattaaatcttagatattgtgggtctccctttcttctattcattttcttattcattaaaa

SEQ ID NO: 34 - DNA, 1024 bp, Arabidopsis thaliana
  misc_feature: Ceres Promoter YP0039
ccgttcgagtatttgaaaatttcgggtacacccgcctaaataggcggaccttatctagtatatatatacatttgaactatattgtttactttttagttgatttaggctatgtcatgacattgacataaatctacctgttatttatcacgtgtaattcgtgtaaagtgtaaactagaaagttcaaatacgtatttgtttttgttctgttatataggattgtcatagttgtaaatctacaatttattacaacatgaataagtacacaagcaatgtaattggatttaattgctaaactctttacatggtcaatctaaatttgataagaaatacgtcacatattactaagactgatagtttttttgttgtcaccaattatttttgttaaattgacgaaaacaattccaaaaactcaaatgtacaaaatcatacagtctcacaaacatctcatagagaaagatataaatctcccatatgggaacgataacacgaggtcgaaatactattcgtaaaactaaaacgccttagttataaatcgttagttgtaaccgcggtcgagaatacatacagatccacgaaactactactacacatgctgctgaattggaatttggaaaagaccatcttctttaggaagagctcacccaatgagtgacaaaggtgtcggtggcttgttttctacccatatgtatacatcaaatggtagtttcattaacgtttggttttgagaaaagtaagactttggctagtagctaggttcgtatataataaactcttttgagaaagttcatcactggtggaaaatgttaaaccggttttttctcattttttccgccatgttaaccaccggtttaaaaagaccgtaacacattgaaagattaataagggtatatttgtaattacggtttgctggcaatttttaattattattttaattagagaaaatagagaagccctatcaatgtacatggtatatatataaaaggcaaaaccctagaaaacgatactattcgactcagccgtcctt

SEQ ID NO: 35 - DNA, 1024 bp, Arabidopsis thaliana
  misc_feature: Ceres Promoter YP0050
aatctgatctctagtccagtcgattggtacttgagggaaacatcatatttttaaaccttgtctcagtaagctaacacacaccccttgtgattacttatccatgtttatccacaagaatgcagttggattgagatattttcttctttgttgaaatcaggcctcaaggtgttcatgtggtctgcaaaaaaattcccaaaaataaagatagtgacatctgaaatcgataatggattagacgaagagtttcgtgttattccttggtatgggcgggtttggggacagatattttggcacagacgaggactaggccactgtggtcctgcagcattaggtgtcccttccatgtcctgcattacattttattgatggattcatcaccctatctactacaacggctacacaaactatgaagagttttgtttactaataaatgcccaagtgaggggtcgatcgaacccgggacacgtttttcagtttaccatatagaattatccttggaacccttgatactccatagaacatcaccacctctgttgtcatctcaggaatccaggttcaaacctagtctctctctccctagtgggaggtatatggccactgggccaatgatgacaaaatgcaaaaaaaataaaatacatttgggttcattatctaaaatatctcttgtgtttgtaagttttggttgcacactcgtgtggttgaagtgtgtgtgagaggtactatacaatacactctgcttttgttttgtacctatctctttctcttctccacatatccaagactttggggataaagctgagatcattggttgccatttggttgtgtagaagcaatcacccatttgctttatccgaggttgataaatttcctcgggttctccttctgacacgtatgacaaattctaatagtatattcctcgtagatattacctatatattctcaatagttgcaggtacttaaggctttgtcttggcatcctcgtcctcttcagcaaaactcgtctctcttgcactccaaaaagcaa

SEQ ID NO: 36 - DNA, 999 bp, Arabidopsis thaliana
  misc_feature: Ceres Promoter YP0086
cttatcctttaacaatgaacaggtttttagaggtagcttgatgattcctgcacatgtgatcttggcttcaggcttaattttccaggtaaagcattatgagatactcttatatctcttacatacttttgagataatgcacaagaacttcataactatatgctttagtttctgcatttgacactgccaaattcattaatctctaatatctttgttgttgatctttggtagacatgggtactagaaaaagcaaactacaccaaggtaaaatacttttgtacaaacataaactcgttatcacggaacatcaatggagtgtatatctaacggagtgtagaaacatttgattattgcaggaagctatctcaggatattatcggtttatatggaatctcttctacgcagagtatctgttattccccttcctctagctttcaatttcatggtgaggatatgcagttttctttgtatatcattcttcttcttctttgtagcttggagtcaaaatcggttccttcatgtacatacatcaaggatatgtccttctgaatttttatatcttgcaataaaaatgcttgtaccaattgaaacaccagctttttgagttctatgatcactgacttggttctaaccaaaaaaaaaaaaatgtttaatttacatatctaaaagtaggtttagggaaacctaaacagtaaaatatttgtatattattcgaatttcactcatcataaaaacttaaattgcaccataaaattttgttttactattaatgatgtaatttgtgtaacttaagataaaaataatattccgtaagttaaccggctaaaaccacgtataaaccagggaacctgttaaaccggttctttactggataaagaaatgaaagcccatgtagacagctccattagagcccaaaccctaaatttctcatctatataaaaggagtgacattagggtttttgttcgtcctcttaaagcttctcgttttctctgccgtctctc

SEQ ID NO: 37 - DNA, 1024 bp, Arabidopsis thaliana
  misc_feature: Ceres Promoter YP0088
tcgattgggattactacttcatctagtaaggttctgaaaacgtttgttgttgataaggaagattcgtctcaggttattactgttgatcttcaaggtttgtgattgtgacgcttatacatgtgctgaaactgtggtgtttatttattgaaaacaaaaaaaaagtctctcttgtagtttcattgtactaaatagaaaacaagaaacgtttttttctttaatcttctacattgataatattggatcaaaggattgtttctgcaagacacaacacaaacatacttatactagtttacttctactaagtactaactacatacccatacacacacttgcacctagactttacttctagacatcattaccctaaggtagaaccaagcttacaagcaagttttaccgacaactcttacattacaactctagtctgtagtctttaacgtagacttactaactagtcattagtggtttaattttttaaattttcatccatatgtttttgttgtagatataaactaaagtcggtcacatttaataattgtcattatgtccgcgtaaaagtcaattcagctattggacatttatgaaatgtaagattttctctctcatttccccgtgcgtgaagacatgcattggtttttctgtaataatcaacaaatccaaaccccttttcgatctttatttggacattgttagagacaaaatttctctatagtctttttcctaatttgataccatgtttttgtttctgcacaaatttactcactggtttaactaactatccacttatttatgattttaccattaggcgtcagctagccctagtcaaatttgtaaacaagccaagctatctacataaatcgagatgtcattaacgttaatcgtcgttaattcgaatttgaaaacatagatagctttagcagtacaatgggcaatggtaagaagaatagcaaaaggcccaatatttggtttgcagaaattaaagccttaaaaaaaagcccacagatatttgtcaaagaaccctaat

SEQ ID NO: 38 - DNA, 1024 bp, Arabidopsis thaliana
  misc_feature: Ceres Promoter YP0092
aaagattgagttgagagagatggtggagacgcagaacagacaaagggagtttaccatatagtgctctaaagggcaatgagattgcagtgatgtggctatccggggaatcatcgcaggttattccttcccatgagcaacaatcaatggatgggttccaattcagaggagaaacagaagaagaaacgtttccagagaaccacagtagggattctcgatcttgcgagttgcagagagcctctgaaactgcaatagaaaggacactgatgaaaagaacacactgaaggagtatgccaatcatgtgaaaactcagagcttgtattggtcttgtggttgatgaagttctcacaaaacctttggctttgaatctcccctcattagtcatggtgagaacaagaacaagacgagaaacagacaaagaagatgaaaaaacttgttggccagtgttgactaagggggaatagccccagacataacaaaattagacttgtcgtacatctttaatatttttttatctgtttctttgtcctgacgctttcattattcctgtgatcaattttctcataccattggtccatcgttaatcctttcttaatttcattttctacgtaacatgagaggagaccaagtcctatgagaacagttgacgtaacagtggttgttaagttaagttaaaaagaggaagctagtgagagtgaccgttaggtagagaagtgagatctttaaccactcttctttctctctctctctgcttttttcgtcgtctttcacatctactgttcgcaaactctcttatgcttccaataatggtgataccaattgagacttgcaggagaatctcctcttctccacactctatcaactggtcagccatggaatggtcgtttcagtttcaatattcctggattctttttaaggattcctgtttctcttctgttcctggtatattcttaacgacgaaattagtatcggatcctggtaatacattttgaagcttttaagtaccattgcactgggatccaacaat

SEQ ID NO: 39 - DNA, 1020 bp, Arabidopsis thaliana
  misc_feature: Ceres Promoter YP0096
gaggtcagtgagtcgattggtgcaaaattgaaaaattgaagggtgaaacaaatttaaagataatatctattaaatcctctaattttaaaaatttagcaaaaattgtattttcttatggatctgttagttcacacgtatcttaattagtaccaaatcatatctaatgattagtgataaaactagttagatatctatatgtgtctttaccatttaacttgaatccttcttcttttttttacgtaaacaacttgaatccttcgttaatacataaatttaaagcattttttctttaattctattgatcggtatatatttactataagttttagctcatatgcaatttcaaatgatatgcttttaaattttgtctaggtgtgatagttgtatctttaacataaatcttatagcaaaattatacttgatattctaaatttatctatttgctcttgtgaacctcatattagtctagagaaactttgaaatcctttcaattagttgtatgtccaatacatttttactaacatttattagtctttttaattaagattattgttagaaaaaaaaagattttttaaaaataaataatatgttttagatacaatgtgagttaggcttcttatattttaaaaaataaatttatttcatacttaaaaatagtttggaatttcaatttatttggctgaataccataaaatatgtcaatttgaaccttatacccattgactatttggtgttagaaaccctttaacaaaaaaaaactatttggtgttagatatcaaaataaaaaaagtttaaccattggtttcttatattgaattggatattgttacatgtattaaagtttttttggtttaattttgaaacgttgatagaaactattaagtttaagtttggtagtatatttatttgtggaaaatttaattgccattaaatataacgtcaactttttttggttttttttgagaagttacgttgtgattttgatttcctatataaaagttagattacgtcattttttaa

SEQ ID NO: 40 - DNA, 1000 bp, Arabidopsis thaliana
  misc_feature: Ceres Promoter YP0097
ttcatctttatatttaagagtttaaaaactgcaacttttgtttttctttcactaagtcttatggccacagttaattaaaagcagatgaaaggtggtccaatggaaaaggagaatgtgattgggctagttgggagagttctgatgtctagtgttgggtacacgtgtccgtcagttacacatagcattaaatcagacggcatgtcattattcaaatctagttcacatagtacgactaatagctgataaattaatgattatacagcatatgaattatgaattcaaaaaaaaaaaaaaattgaaaatgttaaggagatgctatattttacaaaattcatcgcaatgctttctactaatttgctaagtggtcttctccagttagtcttgtcgattccaagcgatattattaaatcttgaagcatcgctcaaagcattatagcttaagataaccaaattgttattaaaaacacctagtgaaatttttaaattaaaacaattttgatatctttgtaatatctaatactactctttctgtgtctaaaaggattaattttcaaaaatttcacacatattaaaaaaaaaaaaaaattactagctaaacaattttcaataatcataaaacaatagtaacttaataatttttttttattttcaaaatagtccttcaagtttacaattcattttagtattataatcaacaaaatttgtattaaaaagttggaaaattaatctttgtggaacaaaaaaatctagaaatcattttttagaattagagagaggtttgataaaaaaaaataaaaaaaaatagagagaggtagtacatactaaacgatgtgatactactattgacaaaatcttaattctcagtttagtagaataaactagaaggaatgaatgaagtaaatgcgaatccaactactaacaaaccctacttagtcatcatattttcccatatgaaatccctatataaacccatcatcatctcccacttttttcatatcca

SEQ ID NO: 41 - DNA, 1004 bp, Arabidopsis thaliana
  misc_feature: Ceres Promoter YP0101
ttctcgttctctagaatattgctggaccggattaggtcaatattattgggccagattagatattgaattgtcgacgttgcttacgttacgttatatcttgtttaagaattaaacctatcgacttagtcttaattaagaaaacattgccttaaattctctggtctgcgaccgtttttttgaccgttaacccctaattaaagaaacaaaataattatagaaagagcactgaaatgtgattattttaacagtactcttatgagaaaattcgtactttttagttttttttttgtacaaatctctaagaaaaacactactactaattaagaaacgtttcaaacaattttattttcgttggctcataatctttctttctcggtccgggactaaccgttggcaaaaaaaaaaaaaaagttgacaataattattaaagcgtaaatcatacctctcaaataaaaacttgaatttggaaacaaagacaactaaaaaactcgaatttaagagaattcctaaaatcaagtgaagtatcatcacttggtaaaatttcataaccgttggcttctatttctatgtgtgccttggtttgcaggagataatatttcatttccaaccaatgatattcgtacacatagtcaaacaaatgtttgtctttgttattatattgagaaagaaacaagaaagagagagagagatagataagacgaaggaagtgaagcttccaagcgcccaccgttaaaaatctcgtgtgcaagtttcaaatacaagtggccggtggtctccataatttgatcgtcatccaattaaaaaggaagaaaaagcgtgttttatacaagaaaactcattaaaatagcaagtctagaaatatctcaacactaatctaccacgtctattacacacacacacacacacacttgatcttaatttattttcaagattcaagaaaatacccattccattaccacaacttgaccacacgcctatatataaaacataaaagccctttcccc

SEQ ID NO: 42 - DNA, 1000 bp, Arabidopsis thaliana
  misc_feature: Ceres Promoter YP0102
atttggttgataacgttttcactcgactaattatatacttcagaaggatagtaatagaataccaaaataattaaatgattggttagtgccttagtggagactttttaaccgattctaatagactaatgatgtagctaagcatttatttgggatcatcactgtttgaaaacgtgaaatgtgataaaagttatgaaacgattaaaatataaaataaccgtacaaaacattatgtaccgtttttttctctgttcttttggcgatttggtttagttcgttacactctaaatgttattgcagatatatatataatgatgcatttgcatctgaggaacatataattccggttaacacttccaaatcttatatccgtctaggtagggattttataaatcatttgtgtcatcatgcgttatgcttgtcggctttgaccataacgcagagatatagaactagcttttacttaacttttagatttattatttgatctagagttaagtggagatatatagtgtttttgttagattattggtggatgtgagagtttgtctttagtttcaagttgagaatataaggcaagaggagactctgaggcaatcagaggttttgattggcaaaatatccaaaaggcccaaaccaagtcgaagcccatctcgtacaaaaaaagaaagagatctgtaagaaaaaatattctttgatattcttacaaaaataagtgtaaaacttttattagtcaaaatcttcaatctttaaaaactctcatcactcctacgaaagcgcgtgagagttatgagacattccttaatagcattactcacaagtcacaagttcaaaacgtctgactgaaacagaaacaagcctttgttgaagtcttgaagaagagacattagtactcgtcgtatagccataaaaggtaatatacgaaatttcttcgctaatctcttcaccttcctctacgcgtttcactttcactttataaatccaaatctcccttcgaaaacat

SEQ ID NO: 43 - DNA, 1004 bp, Arabidopsis thaliana
  misc_feature: Ceres Promoter YP0103
gttttgaagaacaatctggatcgaaatctaacataaggtcatcgtattcaagttacgcagtcaaggacttgacatcatcctactctggtctgaggttaccacttccaaagatgggatttttcgactcggtatgcttcctaagaaattcgttttattgaacctagcaaatatcttgtaatgtaagattcctgagatgatgaagaaaaaacaaacttttgttacagcaggagaacggagagaaagaaaacagagaaccaaatgctcttgaagcaaacagaagaagaagacacaaatccaaacttgagacttcttctacaccagaaaaccgcagcattctgggacaacgcaaaacacgaaagtgaaacgggcaatgatatatatgtcttgggtgcgttacaaggcatcgtttgcaactgttgagttggataagtcaactgtcttcttttcctttggttgtagtagctgccttttttttcctttgttgctttaagaaatagcccgaaaaaaagaatgttctacatttcggagcagaaaactaaccgaatgagtttttggtcggatcatcggatcgatcagatatattttgagttacgaactgttataaaaaaagccataattttgtgttgagtttgcaaaataccttataacttgttatttgagattgcacctccatatatattaattcgtaagagtatttattaagtaagctttagtataaatccttttttcctttaaagtaagttaatgttctactaaataatagtaaagttgaagaaccgctccgtttttacaccatgcacgtgttatctaacaaagaaaatatggtacacctaatggctaatgcaaaggacaacacaatgaaactaacttgactctgtgttatagaaacccatagacatctgcatacatcctagtatttgtataaattggactcaaattcctgaggacaatcatagcaaacaatcacatcatcgcaatatacataaacaaaagaggaagaaaaa

SEQ ID NO: 44 - DNA, 1003 bp, Arabidopsis thaliana
  misc_feature: Ceres Promoter YP0107
taacaatccttgggaacattgcatccatagatatccggttaagatcgatctttgaactcataaaaactagtagattggttggttggtttccatgtaccagaaggcttaccctattagttgaaagttgaaactttgttccctactcaattcctagttgtgtaaatgtatgtatatgtaatgtgtataaaacgtagtacttaaatgactaggagtggttcttgagaccgatgagagatgggagcagaactaaagatgatgacataattaagaacgaatttgaaaggctcttaggtttgaatcctattcgagaatgtttttgtcaaagatagtggcgattttgaaccaaagaaaacatttaaaaaatcagtatccggttacgttcatgcaaatagaaagtggtctaggatctgattgtaattttagacttaaagagtctcttaagattcaatcctggctgtgtacaaaactacaaataatctattttagactatttgggccttaactaaacttccactccattatttactgaggttagagaatagacttgcgaataaacacattccccgagaaatactcatgatcccataattagtcggagggtatgccaatcagatctaagaacacacattccctcaaattttaatgcacatgtaatcatagtttagcacaattcaaaaataatgtagtattaaagacagaaatttgtagacttttttttggcgttaaaagaagactaagtttatacgtacattttattttaagtggaaaaccgaaattttccatcgaaatatatgaatttagtatatatatttctgcaatgtactattttgctattttggcaactttcagtggactactactttattacaatgtgtatggatgcatgagtttgagtatacacatgtctaaatgcatgctttgtaaaacgtaacggaccacaaaagaggatccatacaaatacatctcatagcttcctccattattttccgacacaaacagagca

SEQ ID NO: 45 - DNA, 1024 bp, Arabidopsis thaliana
  misc_feature: Ceres Promoter YP0110
gggatgcggttccgcttcctcttgatcttggacgagtcggaggacattgttggatcccagtgcaatggtaatataaaacaagaaaacaagagattttataggacaatcactaaatgacatttaattgattaaacatttattcattaataattgtatgttactaacttcaacatttaataattttgtttaagatacgtttacatcagagactattaatatttttacaggttgtaactttaaactttgtcttgaatcgaacatgactatagattttgggcaaacttaaagataacaacatttccgttttttttcaaattattacaaatcaaactgatatattagacacaacacgattacacgtaatgaaaaaagaaaaagataaaaagataaaagaagggatcgattctgtttggtctggtttagtgagattcaaagttaagctcttcctttcaagacatgccttcttaaaccgggaatgtgaacgtttgtaatgtagtccgtccagttaatgcttccaacatcaaatccaaattctctcttctcgtcctctgacatattctccattaatctctggggtattgctgttatcaaatctgtaaaagaaaccaaaaaaaaaagatgaaaactttgcgggtaccggttttgtctgctctaagaattagaatgttaatgagttctgtcttaccttccaccatagaaagtgtatggctcataaatagtagcaaggtgtttggcttgttcaacagatttcttgcatataaactttagcttctgcatcatcttactatccactgaactcataccactcatcaacccactccgttcttgagcatctctccacaaatgatccgagaaatcatcaacggaattgaaaagtttcatcaaacgcaccataataggatcacctttagagtccatgcatggagatgttttgtagtggttataaagaagctccgctaagtcttcgaaaaccagcgggtttatcgccgaagaagcgatctgatacacgtttatttcaggttcc

SEQ ID NO: 46 - DNA, 1024 bp, Arabidopsis thaliana
  misc_feature: Ceres Promoter YP0111
cgattggatttagtctatacattatagggcgcaagtttgtggatttaagaattatataaaaacttgaaatatatagtttttatgcattctcctcttgtgtaatacataaaccaaatatgagataggttaatctgtatttcagataatattaaattccaaacaatatttttacttgttataagaaggcaattaatatctctctgttaatggcaagtggtaccaagtagtattaaactattaatgcaatggaagagtactgttggaaattataatcctctatcacacattcaaacagatctcctgaaatcttctcttccaaacttgtacttctctgatccaaatgtaggctccaaaatatagacatttaccatttactaagtccacaactcctttcttgtctccttcaaaaatgactcttgtgtaaccaccatatgactccgacagttcggcattgccatgatgagagcttaaaaattcaccttcctgagcatttcaagtcttcactcccttagcttgacctgaaccaagataaaatgcctttgtcgtcccgtaatatccatcctgctttggacggcatcatagttacattcgatccatcctatttacaatgttattttagtattaaaaacatgacaataaatttgttgttaaacatattcaaatacaatatgattggatttataagtaattgtaatatgaaatgtccttagtaatatgttaaaaaatacatagatacacacacgtactaaaagaggcaacgcgggagatgtcattagaggaagaactaggaagcagagcgttcatgcaaaatgctaccaaaaacgttaatgcaatatctcaactaatcagcacagtccatttcatactgagaatgtaaaaaccaatcagcatcgtccattttttcatctaattatttgttaactcttaattggccacaacttccaaccacatgacgctctttctattccctttatatattcccatctcaaatgttcttggagacacaaaatatcataaacatata

SEQ ID NO: 47 - DNA, 996 bp, Arabidopsis thaliana
  misc_feature: Ceres Promoter YP0115
gtcgattggatgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttac

SEQ ID NO: 48 - DNA, 1024 bp, Arabidopsis thaliana
  misc_feature: Ceres Promoter YP0117
gtcagtgagtcgattggatcacagtcctttatgataaaacaaactcataattattccaccgacaacatgcgttttaaattattttttcttaaattatattatattatattgatatcaacctagctaaaataattcggatggcgaaatcggacaatttttaatagaaaaaatgggtatgaagatagtctatgattccgttcttagcgactagagggacctgctcaaatctcccgggtgatacgcgatgtcaagctcaatagaaccccacaaccgacgagaccgagaaatccttgatttgggctagaagattttgaaataaatttaatatattctaagtaacttgcttaaattttttttcaaactctaaagacataactaacataaagtaaaaaaaaaaaagttaatacatgggaagaaaaaaattaaactaatgattagctctctaacgtgtttaatctcgtatcaagtttttttttaaaaattatattgctattaaaacattgtactattgtttctattttgtttagctattattcttgtgaaatgaaaagttgtgtttattcaattactaaatggcaatatttatcttggaaaactatacctctaattggattaggccctagacatcctctttagcttattgacgttaaaattattcccaaaactattaaagtttagtagtttgaaagatgcatcaagacctactcagataggtaaaagtagaaaactacagttagtgtgattatattttaaaatatataaaacaatcttattaaactaaatattcaagatatatactcaaatggaagataaaaacatttagtctgttaccactaccagcctagctagtcactaatagtcactttggaactgagtagatatttgcatcttgagttaccatggactcaaaagtccaaaaagagaccccgagtgaaaatgctaccaacttaataacaaagaagcatttacagcggtcaaaaagtatctataaatgtttacacaacagtagtcataagcaccattg

SEQ ID NO: 49 - DNA, 1000 bp, Arabidopsis thaliana
  misc_feature: Ceres Promoter YP0119
taccaaaaataaggagtttccaaaagatggttctgatgagaaacagagcccatccctctccttttccccttcccatgaaagaaatcggatggtcctccttcaatgtcctccacctactcttctcttctttctttttttctttcttattattaaccatttaattaatttccccttcaatttcagtttctagttctgtaaaaagaaaatacacatctcacttatagatatccatatctatttatatgcatgtatagagaataaaaaagtgtgagtttctaggtatgttgagtatgtgctgtttggacaattgttagatgatctgtccatttttttcttttttcttctgtgtataaatatatttgagcacaaagaaaaactaataaccttctgttttcagcaagtagggtcttataaccttcaaagaaatattccttcaattgaaaacccataaaccaaaatagatattacaaaaggaaagagagatattttcaagaacaacataattagaaaagcagaagcagcagttaagtggtactgagataaatgatatagtttctcttcaagaacagtttctcattacccaccttctcctttttgctgatctatcgtaatcttgagaactcaggtaaggttgtgaatattatgcaccattcattaaccctaaaaataagagatttaaaataaatgtttcttctttctctgattcttgtgtaaccaattcatgggtttgatatgtttcttggttattgcttatcaacaaagagatttgatcattataaagtagattaataactcttaaacacacaaagtttctttattttttagttacatccctaattctagaccagaacatggatttgatctatttcttggttatgtattcttgatcaggaaaagggatttgatcatcaagattagccttctctctctctctctagatatctttcttgaatttagaaatctttatttaattatttggtgatgtcatatataggatcaa

SEQ ID NO: 50 - DNA, 999 bp, Arabidopsis thaliana
  misc_feature: Ceres Promoter YP0120
tagtttttgatttaatctacgtttttcttaatcataaatgggtaattattagtttttgcaaaatcaaaatccaaaaattgttctaaacactgcaaccatttaaggcctatatcactcagaaaatttctggtgggagaactaatcgtttgtcctttctaaatctcacatattagaatttagaattagtgtgctacataagaatattagttcagctcggaacaactattttttggtaaaacagagaacttaaacaaatgcattattttatcaacatgcattttgaattgaatataaaatttcataattgtaaagacataaattacataaaattttacatgaaaaaatagatatagaaagaaaatgaaactaactgatgatatgctctctaaattttttaatctcataacaagaattcaaattaattagttcatatttttggttaatataacatttacctgtctaagttggaactttcatttttttctgttttgtttagtcagtattcttaatgtgaaacggaaagttgaatttattcaaacttaaattcaatagcattaattaaaggcgaaagctattatctctacatgtggttcaaactagacatccaatttaattagcttattgacgttgaaatgttttccaaaactactatagtttggcaatttgaaagatgcatcagaactactcagacaggtaaaagtagaacctctagctgtgtgaattgtatgttagtccataaagaacatcttgtaaacttcatacttaagatatatattacaatatatacttgaatggtagataaaaacgattagtctgattgctagcatactcacaactatttggaaatgagtaagatattggcattctagagttactactatggagacaaaagtcgaataaaagagacctcacgtgaaaatgttacgagctagtaaaaaaagcatttacactaacggtaaaaaaagtatctataaatgtttacacaaggtagtagtcatt

SEQ ID NO: 51 - DNA, 999 bp, Arabidopsis thaliana
  misc_feature: Ceres Promoter YP0121
ttggattttttttttgttgagtcagcagaccatctaatctctctttttccaccacagcctgctttctatgaagcatttgggcttacggttgtggaatcaatgacttgtgcactcccaacgtttgctacctgtcatggtggacccgcagagattatcgaaaacggagtttctgggttccacattgacccatatcatccagaccaggttgcagctaccttggtcagcttctttgagacctgtaacaccaatccaaatcattgggttaaaatctctgaaggagggctcaagcgaatctatgaaaggttggcccattctccttgacaggcttaacaatacaacttgtatcgcttcaacaagatgatggcttaataaggatttttgcatgtataggtacacatggaagaagtactcagagagactgcttaccctggctggagtctatgcattctggaaacatgtgtctaagctcgaaaggagagaaacacgacgttacctagagatgttttactcattgaaatttcgtgatttggttagtgtaacccactgttattcttttgatgtctacatctactttacttacattattcttttcttcggtttgcaggccaattcaatcccgctggcaacagatgagaactgatcatgacagggtaggattttatttcctgcactttctttagatcttttgtttgtgttatcttgaataaaaattgttgggttttgtttccttcagtggtttgattttggacttatttgtgttaatgttgttttggctgttctcttaatatcaataacaaataaatttactggttggtatctaagatctaacaatagttactatttttagaggtaaagacaccaaccttgttatattggtcagagagctaaaaccttgacttgttgggaaaacaaaactctaatgacagaaaatctgacatgatgccttataattcacagcctcatgttctacataaatcctaacaatagcactttgtttct

SEQ ID NO: 52 - DNA, 1004 bp, Arabidopsis thaliana
  misc_feature: Ceres Promoter YP0128
gataaactgataatggaaaagaacaaagaaaccagtttttaactatttgcatatgtaatttatttgttgcaaattatatttagttaaaatgtttcctctatttatatatatatatatcagtcaagcactatgtataagaaatgtcaatttataaatttttacatgtcctttaacagaaagaaaatgaatttttacatgtcattcatagagagtcactcgtttatttcttatatagagaataacacactcacatgcatatgcatgcaatatgatacattttatgacaaagataatcaacggaaacggtcaagacataatttgataaacaacttgcacgatgcacagatctgatcaaatatataactctttaacatatccaaaatattcaaaaagaaaaactcgatccaaactagcaacatcacgctcacgcggtaggctaaaaatttattaatctccaaaagtctttcttatgaacactgcaaacacaacaacttgaaaagtcatataggtttagatgatgacgcgtattggctatcgcttaccggagtggctcataaatacaataaacaatacgtaaaagtcaaagtcaaatatatttagtcaactataaccattaatcgggcaaaacctttagctgtcaaaacaacgtgaaaacgatatttgtatatatcatcaagaatcagtagataagagaatgatttaatcccctgactattacaattttggtgtaataaacagtctctattggtttttattctttgttttaatttctcatgacctatagagagaattaggtagtttcgaaaattggctaatcaacttttgaaaactactgtctactttgcttaaattctctacacttagtttcggataagataattgtcggactaatagttaatcccttgacaatctttgatattataaaaggtttagttaatctcttctctatataaatattcatacaccagctttcaaaaatatataatccaaacaccaaaaacaaa

SEQ ID NO: 53 - DNA, 1001 bp, Arabidopsis thaliana
  misc_feature: Ceres Promoter YP0137
gtggcacatgctgaaaccccgagcatctctccggaagacacgcgtcgttcgctccaaagaaaacagtcacagctgccggagaatctccgccgtcttcttctgccaccggaaaaactctctccaccactttcagtgcccacctcgtgttatatccactgtatcctcgtagcaccatatcagcctaataaaattttatgtatcaaattttaagacatagccgaaactacactatactagacaataataatatgatttgtttcctgaaaaattatggtttcatgagaaacattaatcatctataaaacaaattagctatggcatcgaagagttatcaatcaaaactgatgaatctttacttaatatatacaacatatctttaccttgcggcggagaagatcggcgagagaagcaccccagccaccgtcactaaaggattcttcagtgatggaatcaccaaagagaaaaaccttccgtctcatcatcttccacacaatcttcttgagaaaatctgagagataagaaaggtgtagtggttttgctgaagtgatcgtgtttgatttagtaaagaaatgctttatttattgttgggggaaacataaataaataaagtaaaagtggatgcactaaatgctttcacccactaatcaccgacctttcatggtttattgtgaaatacactcatagatagacatacaataccttatgtacgtaaataacattttatttgtcgacacttatgtaagtaacgcatagattattttctatgtgattgccactctcagactctcagtttcaaccaataataacaataactacaacaacattaatcataaacatatgctctggtttacaattaaagcttagattaagaaactgtaacaacgttacagaaaaaaaatgttatttacgttttgtaagattagtctctagaatcatcaccgttttttatatattaatgattctttcttatatataaaacctttctcgaaatacccatgaaa

SEQ ID NO: 54 - DNA, 1001 bp, Arabidopsis thaliana
  misc_feature: Ceres Promoter YP0143
atacaacagatggcagatatcgagttaaatacgtgaatcagccgttacgatattttaaaactagaaaattatttaaaaatattgcaaaataccatttaatttcattgttcataaaaaaaagaaattcaaaaacttaaaaactgattcaaaaatttggattaattctcattaacagtcttcaacactacaacaacatgtttctaatttattttatattttaataattaaacaatatatacgtctgcacattgttgctccgacataatctagtataaaaatagttgcagcatatgtgaaaagcaagcagcatttatcactcaatacttttaattttatctgttgtatgtattaaggttttgtagctttaagaaaacgcttataatataaaataacttctaaaagatatttcatgcgtatacaataaatatttgtgaaaaaacatttcgaaaacgtgtacaatatataaactattgtgttatcttttgacattcaaacaaatgttgacaatgtaattttatccatgatatgattggccaattagctgcgaggtaaaaatccgtatacgagtaaaagtaagataaaatttcgcaagaagatttttagcaggaaatctaagacaagtgtcatgaacgtgtcaatcaacaaacgaaaaggagaattatagaatccagattcgacgtaccacattaataaatatcaaaacattttatgttattttatttttgctctggcagttacactctttttcattgctccaataaaaaaatcactcgcatgcatgcatatatatacaccatagtaaactccgcctcttcttcattttaaaagtatcagtttacactgacacaatccttaactattttcctttgttcttcttcatctttattacacatttttttcaaggtaacaaataatctttttaagtcacttttatactctttaaatcttagattgatatatgaatgcatgttaatatttcaagatttataggtctaccaaac

SEQ ID NO: 55 - DNA, 1003 bp, Arabidopsis thaliana
  misc_feature: Ceres Promoter YP0144
aaacgttgcaagattattgattgtgagaaagagtgctcaaggtagtactgatttctgtaaagctcacggtggtgggaaacgatgttcttggggagatgggaaatgtgagaaaatttgctagaggaaagaagcggtttatgcgctgcgcataacactattatgtctcgggagaacaaagatggaagcaagagcggtttgattggaccgggactctttagtggccttgtttttggctctacttctgatcattctcagtctggagctagcgctgtctctgattgtactgattctgttgaacgaatacagtttgagaataggcagaagaacaagaagatgatgataccgatgcaggttctagtaccttcatcaatgaaatctccaagtaattcacatgaaggagaaacaaacatctatgacttcatggttccggaggagagagttcacggcggtgggctagtaatgtctttacttggtggctccattgatcgaaactgaaagccatttatggtaaaagtgtcacattctcagcaaaaacctgtgtaaagctgtaaaatgtgtgggaatctccgaatctgtttgtagccggttacgttatgctggatcaaaaactcaagatttgttggatattgttatgctggatcggtggtgaaaccacttcccggttgctaaataaataaacgtttttgttttataatctttttcactaaacggcagtatgggcctttagtgggcttcctttaagcgaccaatacaatcgtcgcaccggaatctactaccatttataggtttattcatgtaaaacctcggaaaatttgagagccacaacggtcaagagacaaaaacaacttgaagataaagggataaggaaggcttcctacatgatggacaacatttctttccacacaaattctcataataaaaatcttataatacaaatacttacgtcataatcattcaatctagtccccatgttttaaggtcctgtttcttgtctgatacaaat

SEQ ID NO: 56 - DNA, 1004 bp, Arabidopsis thaliana
  misc_feature: Ceres Promoter YP0156
ttggtttgcattgtgaagatttgtattaactatagaacattgaattgatggtgttaagttcttacacaagcgtgcttctcggtttgaactgtttcttttgtatgttgaatcagagcttagtttataggaaccagagtatctacttagtcattctctgatgctaagtgctaaggttctacctagttgccctctaggcccttatgttattgataacttatgaagctatttgaacacttgattcttaggagacctaagttggtacagccagatagagtgtatgttcttgttctctatgtgacaggatcaagctgccacacatagttcaagggtatgctctgtgtgggtttgctcagattgaggacaaatctatacaaggaagtagagtctttgacattttgatgttgtatgataagaagaagaaaggagagtaataaagaaagagaaaagggaaacagaaacacgtgggagaacatcccaaagaggaagcacacgcggatcttcatgcaaagctccccgattctcccatgtggtccctttctccctttgtccccctcctctttcttcttttctcattttactcctttttttaccattatacaacgaatcttttttatcataattttttggttttggtttattttccaataacactttcttggttacttcccattctcactttttcatataagaaactcactttgggaaacttatgtttgagaatgacaagtctttttagagaaagtgatgtaacaaatctaaagtgattatataataaccttgcacaatgtttttgattttttgtaagattcgaatattaggtttattattcgtagggaataaacttactttcaaaagcgttcataagttaatactttcatatatgatcataagtacggacactattgttttttgtttgtttgtgtttattctaaaagaaagtagcttttaattgaaatgtcctcggaggcacagtttaaagttcgagtgtaacagtttctaaggca

SEQ ID NO: 57 - DNA, 1000 bp, Arabidopsis thaliana
  misc_feature: Ceres Promoter YP0158
ttattagattaatagattgcattgcattgcttgtgctttcaatttacaaattgtctcccaactccatcgacacatctctttttgtgtatataagattcagacttgttatattttttttataaatatgttattagcatcttaagttaaattgattttttatatctgcattaaggattacacgactatatttgcgattgtgtgttggttaaaatataatttaggattgtctttaactacatttaggattatatgactatatttggttaaatataaaatctagctgtgattattagtattcaaaaataagtagcctaaccaattaaaacaacggctattggggcaaattagaacattttagtgtgtccaaaatataatggtcattaggtcatattcctcctagcttcatcgcagcataattgaatgattgccttatttagaagagcttttccactttcccaaaatctaggtgggatctttttgttttgaccttcatttttcttgtttaccatttttagctaaattatttacgattacaaaagatatcaaaagttggatcataatacaatttatagacttactgtagaaaattcgtatgtacaagtacaacaaattcttcataataaattttgaaaattctattacaaatgttgtaagaaatagaatttgaaatatatataaactaaggagaaaaaaaaagagaacatgcattgctctagtcagagtggaccaacatcaacgagataagataacataaaaaccaactcaccataactaaaaacatcccaagagatccaacgattcatatcaaacacaaaaacatcgaacgatcagatttaaaccatctctggtatctccaaaacacaaacacttttttttttcttttgtctgaatggaacaaaagcatgcgacatctctgtgtctttatcttctctctcctcttcttgaaaaactgaacctttaattctttcttcacatctcctttagctttctgaagctgcta

SEQ ID NO: 58 - DNA, 1005 bp, Arabidopsis thaliana
  misc_feature: Ceres Promoter YP0188
gattggtatgaaatttcggagaccaacaaaaaaaactttattgagcttggagtgaagctatatatatggggcaagatcataatatgtttatatcggccttttcgttaactgaaaataatagttttgagaaatatatcaaatggtaaacagacatcatctttgaaaaataccatcaatgaagttaatattgttattggcatatggtttacccatcttaattttaatgcaaccaaacaaacaagaaacaaaaactgtataagatacaaggtgttttacgattttccgtcttaaaaccgaaatatttttgttcctacgactttaaacggactttgcttaagttgtgtgcatgtaagctcgtcgtccctcgattgtcatcaacattcaccaatatcagcctctatcacacgagtgaaggtggtgattcggcttaatgaaaacagagaaatatttcaatatgattcctattaaattttaaatcttttttctcaatctctagattttcattaaaagcatcatgatttttttccactatgttcatatatctctatcacagttttaggtacattgtagaaattggataagatacgtcatacgtctaacatgaatttggtctagcaaggaaggtttgagataataagtgaaaagaaaacacaagataataaattataatttataaatgctttatagtattgaaaaataagatgattttttttttttttaataccggattggctgatccacttatgatgactcaaatgttattaagtttcaagacaatttatgatgacacaaatcacaatgagtcaatagtagccacgaagccagaaaaaaaaaatgtactacaaaaagataatgatagtacaaaatgatacgtcgtactgccacatgtacgacacaactcgattaccaaaaagcagagccatccaaccataaaactcaaaacacacagattccactggcgtgtgctctcctcacttcactcgtccttgaaacttgaggtactga

SEQ ID NO: 59 - DNA, 1002 bp, Arabidopsis thaliana
  misc_feature: Ceres Promoter YP0190
taaatagtgacattggtaagaagaaaaaaaacactattaaatagtgaaaaaatggtttataactctcttaattaacattacttattattgctagcacctaaaatctcccacaaaatatttgttgtaaaacacaaatttacaaaatgattttgtttttaaattagtaacacatgttcatatatacgttaataagaacataccctatatgattttatataaaaaaatttctttgagacgtcttattcttttttctttaataatatgcaattgtgagagtttggatttgaatggtagcattagaagcaaacttgaaccaaacatatttcatgaagtcaaacttgaaccaatgtgatcactaatcacagtgttcgcagtgtaaggcatcagaaaatagaagaagggacatagctatgaatcatataatcttgacacatgttttataggttttaggtgtgtatgctaacaaaaaatgagacagctttcttctaatagacttaatatttgggctaaatgtaccacagttgtgaatttcttacaaaaatgggccgagctacaaaaaactacaggcccactctcaactcttatcaaacgacagcgttttacttttttaaaagcacacactttttgtttggtgtcggtgacggtgagtttcgtccgctcttcctttaaattgaagcaacggttttgatccgatcaaatccaacggtgctgattacacaaagcccgagacgaaaacgttgactattaagttaggttttaatctcagccgttaatctacaaatcaacggttccctgtaaaacgaatcttccttccttcttcacttccgcgtcttctctctcaatcacctcaaaaaaatcgatttcatcaaaatattcacccgcccgaatttgactctccgatcatcgtctccgaatctagatcgacgagatcaaaaccctagaaatctaaatcggaatgagaaattgattttgatacgaattagggatctgtgtgttgaggac

SEQ ID NO: 60 - DNA, 995 bp, Arabidopsis thaliana
  misc_feature: Ceres Promoter YP0212
agtcgattggtacactcttaatttaattagagtaagagatcaacaaaaatatagaattttctttatatcgaagtgctacgaccttatatatatagaaaaaaaagcataggtgaatctctaaattgagattgtgctgtagtaaacatattaagtttttagtttttttaagaaatgaatctttttgttgattaattcaaactagtagtcattaagattccggagattccaatttagaaaagtcaaagattcaaagaacaagtccaggtccacatgttgaatccgattcatcatccactcatccttcatatcttcctccaccgtctccgcccaaaaaatcaataacaataaaaaatcctaaaaaaacatatttgattttgaaaaaactttatcatatattatattaattaaatagttatccgatgactcatcctatggtcagggccttgctgtctctgacgtccttaattatcattatttttaaatttgtctctctcagaaaattacgccacaatcttcctctttcccttttccgaaaacagctaatatttgtggacctaaactaaataacgtagcctctagattttatataattactaatactatatgctactacttgttattatttactccaatcatatatgataccaatcaagaatcactacataagtagaaaactttgcaatgagtccattaattaaaattaagaataaacttaaaattttatggtattttaagattccctttggattgtaatgacaagaaatcagcaaattagtcgtaactcgtaagaataaacaagatcaatttttactttctttacaaagattccgttgtaattttagaaatttttttttgtcactgtttttttatagattaatttatctgcatcaatccgattaagaagtgtacacatgggcatctatatatatctaacaggtaaaacgtgtatgtacatgcataaggttttacgtgcttctataaatatatgtggcagt

SEQ ID NO: 61 - DNA, 1024 bp, Arabidopsis thaliana
  misc_feature: Ceres Promoter YP0214
ccagtcgattggcgcctcgcatgcctatcatatttaaccgtcaataatggatttggcggttttggtaggccgggtcaaccggattaaaagaaaacggtttggagtccttccttgcaattgaattttcacacattcgggttttgtgatttctctgtcataatgggcccggcacatatggttcataacccatgtgggcctatggtataatttttccaattaaaactattgttaggtcgataaaacaaaaaacaataaaaacgagtggaatacacataccaaaaagaatgtgatgaacattagtaattttattttgatggttaatgaaaaacaaaataaatgcatcttggcatcttccgttggaaagcgcaaatagggcagattttcagacagatatcactatgatggggggtgagagaaagaaaacgaggcgtacctaatgtaacactacttaattagtcgttagttataggactttttttttgtttgggcctagttataggatcataaggtaaaaatgaagaatgaatattagattagtaggagctaatgatggagttaagtatgcacgtgtaagaactgggaagtgaaacctcctgtatggtgaagaaactatacaacaaagccctttgttggtgtatacgtattaatttttattcttttatcacaagcgatacgtatcttaagacataataaatatatatcttactcataataaatatcttaagatatatatacagtatacacctgtatatatataataaataggcatatagtagaaattaatatgagttgttgttgttgcaaatatataaatcaatcaaaagatttaaaacccaccattcaatcttggtaagtaacgaaaaaaaagggaagcaagaagaaccacagaaaagggggctaacaactagacacgtagatcttcatctgcccgtccatctaacctaccacactctcatcttctttttcccgtgtcagtttgttatataagctctcactctccggtatatttccccattgcactgga

SEQ ID NO: 62 - DNA, 911 bp, Arabidopsis thaliana
  misc_feature: Ceres Promoter YP0263
atctagctgtggattccaccaaaattctggcagggccatgatctaaaaactgagactgcgcgtgttgttttgcagtgatttgtatttcatatttgcaccatcctacacagtccacttggtatcgtaaccaaacataaggagaacctaattacattattgttttaatttcgtcaaactggtttttaccttttagttacatagttgattcttcatttgttttagtagttatggagcacaataatgtgcaacaaagaaagatcatagtggattaatatgttgagaggtcagaaattcttggttaacaaaaaaaagttacaaggactgagattttgggtgggagaaagccatagcttttaaaacatgattgaacttaaaagtgatgttatggtttgaggggaaaaaggttgatgtcaactaagatagttgaagtaatgtcttaaactaaagtaaaccaccggtccaaccgtggtccggaagcatctctggtatgatttatcctaaaaatcaaaatagtagaaacatactttaaatatatacattgatcggacgaaaattgtaaactagtatagtttcaaaaactagttgaacaggttatgtaccttaaacatttatttcaaacttaaacactaaagaacatatatgaatagaagtttatataaattactatatatctaccataaatctcttataattatgatgtcacgatgaggaagtgttgaaacgttaaaatgccaaaatataagcatgcgacggaattttggcagaagattgtagagttgtaatctgtcgcaatcattactcgtgctagcatttttcattttcccttcatttgtggataacgcacgatataacattctacacaccaacaagattctataaaaacgcaaaggttgtctccatagaatatcgtc

SEQ ID NO: 63 - DNA, 999 bp, Arabidopsis thaliana
  misc_feature: Ceres Promoter YP0275
aaacattaatatgtagtaactatgggcgtatgctttactttttaaaatgggcctatgctataattgaatgacaaggattaaacaactaataaaattgtagatgggttaagatgacttatttttttacttaccaatttataaatgggcttcgatgtactgaaatatatcgcgcctattaacgaggccattcaacgaatgttttaagggccctatttcgacattttaaagaacacctaggtcatcattccagaaatggatattataggatttagataatttcccacgtttggtttatttatctattttttgacgttgaccaacataatcgtgcccaaccgtttcacgcaacgaatttatatacgaaatatatatatttttcaaattaagataccacaatcaaaacagctgttgattaacaaagagattttttttttttggttttgagttacaataacgttagaggataaggtttcttgcaacgattaggaaatcgtataaaataaaatatgttataattaagtgttttattttataatgagtattaatataaataaaacctgcaaaaggatagggatattgaataataaagagaaacgaaagagcaattttacttctttataattgaaattatgtgaatgttatgtttacaatgaatgattcatcgttctatatattgaagtaaagaatgagtttattgtgcttgcataatgacgttaacttcacatatacacttattacataacatttatcacatgtgcgtctttttttttttttactttgtaaaatttcctcacttttaagacttttataacaattactagtaaaataaagttgcttggggctacaccctttctccctccaacaactctatttatagataacattatatcaaaatcaaaacatagtccctttcttctataaaggttttttcacaaccaaatttccattataaatcaaaaaataaaaacttaattagtttttacagaagaaaagaaaaca

SEQ ID NO: 64 - DNA, 981 bp, Arabidopsis thaliana
  misc_feature: Ceres Promoter YP0285
gggattatatatgatagacgattgtatttgcgggacattgagatgtttccgaaaatagtcatcaaatatcaaaccagaatttgatgtgaaaacactaattaaaacatataattgacaactagactatatcatttgttaagttgagcgttgaaagaaaatgaaagagtgtagactgtagtacgtatgagtttcccaaaagatggtgcttgaatattattgggaagagactttggttggttcggttgaatgaagatttttacctgccatgttgatagagaaaggcaaataaatgtaggggtcgatgtctaacgtaaagactggatcaaccaagagtcctcctcctcgtcttcaccaaaaaaaaagagtcctcctcgtggaaacttatttcttctccagccaagatctcatctcatctcttcactctatgaaatataaaggaatcttatggtttttctaaaaactatagtacgtctatataccaaaggaaacaatataaaatcagttaatctgataaattttgagtaaataataaagttaactttgtacttacctatatcaaactaattcacaaaataaagtaataataacaaagaatttttagtagatccacaatatacacacacactatgagaaatcataatagagaattttaatgattttgtctaactcatagcaacaagtcgctttggccgagtggttaaggcgtgtgcctgctaagtacatgggctctgcccgcgagagttcgaatctctcaggcgacgtttcttttgttttcggccataaaggaaaaagcccaattaacacgtctcgcttataagcccataaagcaaacaatgggctgtctctgtctcactcacacacgcgttttcctactttttgactatttttataaccggcgggtctgacttaattagggttttctttaataatcagacactctctcactcgtttcgtcaacattgaacacagacaaaaccgcgt

SEQ ID NO: 65 - DNA, 996 bp, Arabidopsis thaliana
  misc_feature: Ceres Promoter YP0286
gaaaacaatcataggttacgctattatcatcgaaaggtatgtgatgcatattcccattgaaccagatttccatatattttatttgtaaagtgataatgaatcacaagatgattcaatattaaaaatgggtaactcactttgacgtgtagtacgtggaagaatagttagctatcacgcatacatatatctatgaataagtgtgtatgacataagaaactaaaatatttacctaaagtccagttactcatactgatttcatgcatatatgtattatttatttatttttaataaagaagcgattggtgttttcatagaaatcatgatagattgataggtatttcagttccacaaatctagatctgtgtgctatacatgcatgtattaattttttccccttaaatcatttcagttgataatattgctctttgttccaactttagaaaaggtatgaaccaacctgacgattaacaagtaaacattaattaatctttatatgagataaaaccgaggatatatatgattgtgttgctgtctattgatgatgtgtcgatattatgcttgttgtaccaatgctcgagccgagcgtgatcgatgccttgacaaactatatatgtttcccgaattaattaagttttgtatcttaattagaataacatttttatacaatgtaatttctcaagcagacaagatatgtatcctatattaattactatatatgaattgccgggcacctaccaggatgtttcaaatacgagagcccattagtttccacgtaaatcacaatgacgcgacaaaatctagaatcgtgtcaaaactctatcaatacaataatatatatttcaagggcaatttcgacttctcctcaactcaatgattcaacgccatgaatctctatataaaggctacaacaccacaaaggatcatcagtcatcacaaccacattaactcttcaccactatctctcaatctctcgtttcatttcttgacgcgtgaaaa

SEQ ID NO: 66 - DNA, 1000 bp, Arabidopsis thaliana
  misc_feature: Ceres Promoter YP0337
taatttttttatttttggaactaacacttattagtttaggtttccatcacctatttaattcgtaattcttatacatgcatataatagagatacatatatacaaatttatgatcatttttgcacaacatgtgatctcattcattagtatgcattatgcgaaaacctcgacgcgcaaaagacacgtaatagctaataatgttactcatttataatgattgaagcaagacgaaaacaacaacatatatatcaaattgtaaactagatatttcttaaaagtgaaaaaaaacaaagaaatataaaggacaattttgagtcagtctcttaatattaaaacatatatacataaataagcacaaacgtggttacctgtcttcatgcaatgtggactttagtttatctaatcaaaatcaaaataaaaggtgtaatagttctcgtcatttttcaaattttaaaaatcagaaccaagtgatttttgtttgagtattgatccattgtttaaacaatttaacacagtatatacgtctcttgagatgttgacatgatgataaaatacgagatcgtctcttggttttcgaattttgaactttaatagttttcttttttagggaaactttaatagttgtttatcataagattagtcacctaatggttacgttgcagtaccgaaccaattttttacccttttttctaaatgtggtcgtggcataatttccaaaagagatccaaaacccggtttgctcaactgataagccggtcggttctggtttgaaaaacaagaaataatctgaaagtgtgaaacagcaacgtgtctcggtgtttcatgagccacctgccacctcattcacgtcggtcattttgtcgtttcacggttcacgctctagacacgtgctctgtccccaccatgactttcgctgccgactcgcttcgctttgcaaactcaaacatgtgtgtatatgtaagtttcatcctaataagcatctcttaccacattaattaaaaa

SEQ ID NO: 67 - DNA, 1000 bp, Arabidopsis thaliana
  misc_feature: Ceres Promoter YP0356
ttagttcattgaaacgtcaactttttacttgcaaccactttgtaggaccattaactgcaaaataagaattctctaagcttcacaaggggttcgtttggtgctataaaaacattgttttaagaactggtttactggttctataaatctataaatccaaatatgaagtatggcaataataataacatgttagcacaaaaaatactcattaaattcctacccaaaaaaaatctttatatgaaactaaaacttatatacacaataatagtgatacaaagtaggtcttgatattcaactattcgggattttctggtttcgagtaattcgtataaaaggtttaagatctattatgttcactgaaatcttaactttgttttgtttccagttttaactagtagaaattgaaatttttaaaaattgttacttacaataaaatttgaatcaatatccttaatcaaaggatcttaagactagcacaattaaaacatataacgtagaatatctgaaataactcgaaaatatctgaactaagttagtagttttaaaatataatcccggtttggaccgggcagtatgtacttcaatacttgtgggttttgacgattttggatcggattgggcgggccagccagattgatctattacaaatttcacctgtcaacgctaactccgaacttaatcaaagattttgagctaaggaaaactaatcagtgatcacccaaagaaaacattcgtgaataattgtttgctttccatggcagcaaaacaaataggacccaaataggaatgtcaaaaaaaagaaagacacgaaacgaagtagtataacgtaacacacaaaaataaactagagatattaaaaacacatgtccacacatggatacaagagcatttaaggagcagaaggcacgtagtggttagaaggtatgtgatataattaatcggcccaaatagattggtaagtagtagccgtctatatcatccatactcatcataacttcaacct

SEQ ID NO: 68 - DNA, 1000 bp, Arabidopsis thaliana
  misc_feature: Ceres Promoter YP0374
aagacacccgtaaatgttgtcatgtagaagaaactagaaacgttaaacgcatcaaatcaagaaattaaattgaaggtaatttttaacgccgcctttcaaatattcttcctaggagaggctacaagacgcgtatttctttcgaattctccaaaccattaccattttgatatataataccgacatgccgttgataaagtttgtatgcaaatcgttcattgggtatgagcaaatgccatccattggttcttgtaattaaatggtccaaaaatagtttgttcccactactagttactaatttgtatcactctgcaaaataatcatgatataaacgtatgtgctatttctaattaaaactcaaaagtaatcaatgtacaatgcagagatgaccataaaagaacattaaaacactacttccactaaatctatggggtgccttggcaaggcaattgaataaggagaatgcatcaagatgatatagaaaatgctattcagtttataacattaatgttttggcggaaaattttctatatattagacctttctgtaaaaaaaaaaaaatgatgtagaaaatgctattatgtttcaaaaatttcgcactagtataatacggaacattgtagtttacactgctcattaccatgaaaaccaaggcagtatataccaacattaataaactaaatcgcgatttctagcacccccattaattaattttactattatacattctctttgcttctcgaaataataaacttctctatatcattctacataataaataagaaagaaatcgacaagatctaaatttagatctattcagctttttcgcctgagaagccaaaattgtgaatagaagaaagcagtcgtcatcttcccacgtttggacgaaataaaacataacaataataaaataataaatcaaatatataaatccctaatttgtctttattactccacaattttctatgtgtatatatatacccacctctctcttgtgtatttg

SEQ ID NO: 69 - DNA, 998 bp, Arabidopsis thaliana
  misc_feature: Ceres Promoter YP0377
tataaaccattcctataacaccatatttaaacataacaatgaattgcttggatttcaaactttattaaatttggattttaaattttaatttgattgaattatacccccttaattggataaattcaaatatgtcaactttttttttgtaagatttttttatggaaaaaaaaattgattattcactaaaaagatgacaggttacttataatttaatatatgtaaaccctaaaaagaagaaaatagtttctgttttcactttaggtcttattatctaaacttctttaagaaaatcgcaataaattggtttgagttctaactttaaacacattaatatttgtgtgctatttaaaaaataatttacaaaaaaaaaaacaaattgacagaaaatatcaggttttgtaataagatatttcctgataaatatttagggaatataacatatcaaaagattcaaattctgaaaatcaagaatggtagacatgtgaaagttgtcatcaatatggtccacttttctttgctctataacccaaaattgaccctgacagtcaacttgtacacgcggccaaacctttttataatcatgctatttatttccttcatttttattctatttgctatctaactgatttttcattaacatgataccagaaatgaatttagatggattaattcttttccatccacgacatctggaaacacttatctcctaattaaccttactttttttttagtttgtgtgctccttcataaaatctatattgtttaaaacaaaggtcaataaatataaatatggataagtataataaatctttattggatatttctttttttaaaaaagaaataaatcttttttggatattttcgtggcagcatcataatgagagactacgtcgaaaccgctggcaaccacttttgccgcgtttaatttctttctgaggcttatataaatagatcaaaggggaaagtgagatataatacagacaaaacaagagaaaaga

SEQ ID NO: 70 - DNA, 999 bp, Arabidopsis thaliana
  misc_feature: Ceres Promoter YP0380
acaagtaccattcacttttttacttttcaatgtatacaatcatcatgtgataaaaaaaaaaatgtaaccaatcaacacactgagatacggccaaaaaatggtaatacataaatgtttgtaggttttgtaatttaaatactttagttaagttatgattttattatttttgcttatcacttatacgaaatcatcaatctattggtatctcttaatcccgctttttaatttccaccgcacacgcaaatcagcaaatggttccagccacgtgcatgtgaccacatattgtggtcacagtactcgtcctttttttttcttttgtaatcaataaatttcaatcctaaaacttcacacattgagcacgtcggcaacgttagctcctaaatcataacgagcaaaaaagttcaaattagggtatatgatcaattgatcatcactacatgtctacataattaatatgtattcaaccggtcggtttgttgatactcatagttaagtatatatgtgctaattagaattaggatgaatcagttcttgcaaacaactacggtttcatataatatgggagtgttatgtacaaaatgaaagaggatggatcattctgagatgttatgggctcccagtcaatcatgttttgctcgcatatgctatcttttgagtctcttcctaaactcatagaataagcacgttggttttttccaccgtcctcctcgtgaacaaaagtacaattacattttagcaaattgaaaataaccacgtggatggaccatattatatgtgatcatattgcttgtcgtcttcgttttcttttaaatgtttacaccactacttcctgacacgtgtccctattcacatcatccttgttatatcgttttacttataaaggatcacgaacaccaaaacatcaatgtgtacgtcttttgcataagaagaaacagagagcattatcaattattaacaattacacaagacagcgagattgtaaaagagtaagagagagag

SEQ ID NO: 71 - DNA, 1000 bp, Arabidopsis thaliana
  misc_feature: Ceres Promoter YP0381
cacggtcaaagtattgctaacatggtcattacattgaaaaagaaaattaattgtctttactcatgtttattctatacaaataaaaatattaaccaaccatcgcactaacaaaatagaaatcttattctaatcacttaattgttgacaattaaatcattgaaaaatacacttaaatgtcaaatattcgttttgcatacttttcaatttaaatacatttaaagttcgacaagttgcgtttactatcatagaaaactaaatctcctaccaaagcgaaatgaaactactaaagcgacaggcaggttacataacctaacaaatctccacgtgtcaattaccaagagaaaaaaagagaagataagcggaacacgtggtagcacaaaaaagataatgtgatttaaattaaaaaacaaaaacaaagacacgtgacgacctgacgctgcaacatcccaccttacaacgtaataaccactgaacataagacacgtgtacgatcttgtctttgttttctcgatgaaaaccacgtgggtgctcaaagtccttgggtcagagtcttccatgattccacgtgtcgttaatgcaccaaacaagggtactttcggtattttggcttccgcaaattagacaaaacagctttttgtttgattgatttttctcttctctttttccatctaaattctctttgggctcttaatttctttttgagtgttcgttcgagatttgtcggagattttttcggtaaatgttgaaattttgtgggatttttttttatttctttattaaacttttttttattgaatttataaaaagggaaggtcgtcattaatcgaagaaatggaatcttccaaaatttgatattttgctgttttcttgggatttgaattgctctttatcatcaagaatctgttaaaatttctaatctaaaatctaagttgagaaaaagagagatctctaatttaaccggaattaatattctccgaccgaagttattatgttgcaggct

SEQ ID NO: 72 - DNA, 999 bp, Arabidopsis thaliana
  misc_feature: Ceres Promoter YP0384
tttaaaaaattggataaaacaccgataaaaattcacatttgcaaattttattcagtcggaatatatatttgaaacaagttttgaaatccattggacgattaaaattcattgttgagaggataaatatggatttgttcatctgaaccatgtcgttgattagtgattgactaccatgaaaaatatgttatgaaaagtataacaacttttgataaatcacatttattaacaataaatcaagacaaaatatgtcaacaataatagtagtagaagatattaattcaaattcatccgtaacaacaaaaaatcataccacaattaagtgtacagaaaaaccttttggatatatttattgtcgcttttcaatgattttcgtgaaaaggatatatttgtgtaaaataagaaggatcttgacgggtgtaaaaacatgcacaattcttaatttagaccaatcagaagacaacacgaacacttctttattataagctattaaacaaaatcttgcctattttgcttagaataatatgaagagtgactcatcagggagtggaaaatatctcaggatttgcttttagctctaacatgtcaaactatctagatgccaacaacacaaagtgcaaattcttttaatatgaaaacaacaataatatttctaatagaaaattaaaaagggaaataaaatatttttttaaaatatacaaaagaagaaggaatccatcatcaaagttttataaaattgtaatataatacaaacttgtttgcttccttgtctctccctctgtctctctcatctctcctatcttctccatatatacttcatcttcacacccaaaactccacacaaaatatctctccctctatctgcaaattttccaaagttgcatcctttcaatttccactcctctctaatataattcacattttcccactattgctgattcatttttttttgtgaattatttcaaacccacataaaaaaatctttgtttaaatttaaaacca

SEQ ID NO: 73 - DNA, 998 bp, Arabidopsis thaliana
  misc_feature: Ceres Promoter YP0385
actcaacaataggacaagccaaaaaaattccaattattgtgttactctattcttctaaatttgaacactaatagactatgacatatgagtatataatgtgaagtcttaagatattttcatgtgggagatgaataggccaagttggagtctgcaaacaagaagctcttgagccacgacataagccaagttgatgaccgtaattaatgaaactaaatgtgtgtggttatatattagggacccatggccatatacacaatttttgtttctgtcgatagcatgcgtttatatatatttctaaaaaaactaacatatttactggatttgagttcgaatattgacactaatataaactacgtaccaaactacatatgtttatctatatttgattgatcgaagaattctgaactgttttagaaaatttcaatacacttaacttcatcttacaacggtaaaagaaatcaccactagacaaacaatgcctcataatgtctcgaaccctcaaactcaagagtatacattttactagattagagaatttgatatcctcaagttgccaaagaattggaagcttttgttaccaaacttagaaacagaagaagccacaaaaaaagacaaagggagttaaagattgaagtgatgcatttgtctaagtgtgaaaggtctcaagtctcaactttgaaccataataacattactcacactccctttttttttctttttttttcccaaagtaccctttttaattccctctataacccactcactccattccctctttctgtcactgattcaacacgtggccacactgatgggatccacctttcctcttacccacctcccggtttatataaacccttcacaacacttcatcgctctcaaaccaactctctcttctctcttctctcctctcttctacaagaagaaaaaaaacagagcctttacacatctcaaaatcgaacttactttaaccaccaaatactgattgaacacacttgaaa

SEQ ID NO: 74 - DNA, 1000 bp, Arabidopsis thaliana
  misc_feature: Ceres Promoter YP0396
catagtaaaagtgaatttaatcatactaagtaaaataagataaaacatgttatttgaatttgaatatcgtgggatgcgtatttcggtatttgattaaaggtctggaaaccggagctcctataacccgaataaaaatgcataacatgttcttccccaacgaggcgagcgggtcagggcactagggtcattgcaggcagctcataaagtcatgatcatctaggagatcaaattgtatgtcggccttctcaaaattacctctaagaatctcaaacccaatcatagaacctctaaaaagacaaagtcgtcgctttagaatgggttcggtttttggaaccatatttcacgtcaatttaatgtttagtataatttctgaacaacagaattttggatttatttgcacgtatacaaatatctaattaataaggacgactcgtgactatccttacattaagtttcactgtcgaaataacatagtacaatacttgtcgttaatttccacgtctcaagtctataccgtcatttacggagaaagaacatctctgtttttcatccaaactactattctcactttgtctatatatttaaaattaagtaaaaaagactcaatagtccaataaaatgatgaccaaatgagaagatggttttgtgccagattttaggaaaagtgagtcaaggtttcacatctcaaatttgactgcataatcttcgccattaacaacggcattatatatgtcaagccaattttccatgttgcgtacttttctattgaggtgaaaatatgggtttgttgattaatcaaagagtttgcctaactaatataactacgactttttcagtgaccattccatgtaaactctgcttagtgtttcatttgtcaacaatattgtcgttactcattaaatcaaggaaaaatatacaattgtataattttcttatattttaaaattaattttgatgtattacccctttataaataggctatcgctacaacaccaataac

SEQ ID NO: 75 - DNA, 1514 bp, Arabidopsis thaliana
  misc_feature: Ceres Promoter p13879
tttcgatcctcttcttttttaggtttcttgatttgatgatcgccgccagtagagccgtcgtcggaagtttcagagattaaaaccatcaccgtgtgagttggtagcgaattaacggaaagtctaagtcaagattttttaaaaagaaatttatgtgtgaaaagaagccgttgtgtatatttatataatttagaaaatgtttcatcattttaattaaaaaattaataatttgtagaagaaagaagcattttttatacataaatcatttaccttctttactgtgtttttcttcacttacttcatttttacttttttacaaaaaagtgaaaagtaaattacgtaattggtaacataaattcactttaaatttgcatatgttttgttttcttcggaaactatatcgaaaagcaaacggaaagaacttcacaaaaaaccctagctaactaaagacgcatgtgttcttcttattcttcatatatcctctgtttcttgtgttctgttttgagtcttacattttcaatatctgactctgattactatatctaaaagggaacatgaagaacttgagaccatgttaaactgtacaatgccttcaaacatggctaactaaagatacattagatggctttacagtgtgtaatgcttattatctttaggttttttaaatcccttgtattaagttatttaccaaattatgttcttgtactgcttattggcttggttgttgtgtgctttgtaaacaacacctttggctttatttcatcctttgtaaacctactggtctttgttcagctcctcttggaagtgagtttgtatgcctggaacgggttttaatggagtgtttatcgacaaaaaaaaaatgtagcttttgaaatcacagagagtagttttatattcaaattacatgcatgcaactaagtagcaacaaagttgatatggccgagttggtctaaggcgccagattaaggttctggtccgaaagggcgtgggttcaaatcccactgtcaacattctctttttctcaaattaatatttttctgcctcaatggttcaggcccaattatactagactactatcgcgactaaaatagggactagccgaattgatccggcccagtatcagttgtgtatcaccacgttatttcaaatttcaaactaagggataaagatgtcatttgacatatgagatatttttttgctccactgagatatttttctttgtcccaagataaaatatcttttctcgcatcgtcgtctttccatttgcgcattaaaccaaaaagtgtcacgtgatatgtccccaaccactacgaattttaactacagatttaaccatggttaaaccagaattcacgtaaaccgactctaaacctagaaaatatctaaaccttggttaatatctcagcccccttataaataacgagacttcgtctacatcgttctacacatctcactgctcactactctcactgtaatcccttagatcttcttttcaaatttcaccattgcactggatg

SEQ ID NO: 76 - DNA, 1954 bp, Arabidopsis thaliana
  misc_feature: Ceres Promoter p326
gtgggtaaaagtatccttctttgtgcatttggtatttttaagcatgtaataagaaaaaccaaaatagacggctggtatttaataaaaggagactaatgtatgtatagtatatgatttgtgtggaatataataaagttgtaaaatatagatgtgaagcgagtatctatcttttgactttcaaaggtgatcgatcgtgttctttgtgatagttttggtcgtcggtctacaagtcaacaaccaccttgaagttttcgcgtctcggtttcctcttcgcatctggtatccaatagcatacatataccagtgcggaaaatggcgaagactagtgggcttgaaccataaggtttggccccaatacggattccaaacaacaagcctagcgcagtcttttgggatgcataagactaaactgtcgcagtgatagacgtaagatatatcgacttgattggaatcgtctaagctaataagtttaccttgaccgtttatagttgcgtcaacgtccttatggagattgatgcccatcaaataaacctgaaaatccatcaccatgaccaccataaactcccttgctgccgctgctttggcttgagcaaggtgtttccttgtaaagctccgatctttggataaagtgttccactttttgcaagtagctctgacccctctcagagatgtcaccggaatcttagacagaacctcctctgccaaatcacttggaagatcggacaatgtcatcatttttgcaggtaatttctccttcgttgctgctttggcttgagcacggtgcttctttgtaaagctccgatctttggataagagcggatcggaatcctctaggaggtgccagtcccttgacctattaatttatagaaggttttagtgtattttgttccaatttcttctctaacttaacaaataacaactgcctcatagtcatgggcttcaaattttatcgcttggtgtatttcgttatttgcaaggccttggcccattttgagcccaataactaaatctagccttttcagaccggacatgaacttcgcatattggcgtaactgtgcagttttacctttttcggatcagacaagatcagatttagaccacccaacaatagtcagtcatatttgacaacctaagctagccgacactactaaaaagcaaacaaaagaagaattctatgttgtcattttaccggtggcaagtggacccttctataaaagagtaaagagacagcctgtgtgtgtataatctctaattatgttcaccgacacaatcacacaaacccttctctaatcacacaacttcttcatgatttacgacattaattatcattaactctttaaattcactttacatgctcaaaaatatctaatttgcagcattaatttgagtaccgataactattattataatcgtcgtgattcgcaatcttcttcattagatgctgtcaagttgtactcgcacgcggtggtccagtgaagcaaatccaacggtttaaaaccttcttacatttctagatctaatctgaaccgtcagatatctagatctcattgtctgaacacagttagatgaaactgggaatgaatctggacgaaattacgatcttacaccaaccccctcgacgagctcgtatatataaagcttatacgctcctccttcaccttcgtactactactaccaccacatttctttagctcaaccttcattactaatctccttttaaggtatgttcacttttcttcgattcatactttctcaagattcctgcatttctgtagaatttgaaccaagtgtcgatttttgtttgagagaagtgttgatttatagatctggttattgaatctagattccaatttttaattgattcgagtttgttatgtgtgtttatactacttctcattgatcttgtttgatttctctgctctgtattaggtttctttcgtgaatcagatcggaa

SEQ ID NO: 77 - DNA, 2016 bp, Arabidopsis thaliana
  misc_feature: Ceres Promoter p32449
gatcggccttcttcaggtcttctctgtagctctgttacttctatcacagttatcgggtatttgagaaaaaagagttagctaaaatgaatttctccatataatcatggtttactacaggtttacttgattcgcgttagctttatctgcatccaaagttttttccatgatgttatgtcatatgtgataccgttactatgtttataactttatacagtctggttcactggagtttctgtgattatgttgagtacatactcattcatcctttggtaactctcaagtttaggttgtttgaattgcctctgttgtgatacttattgtctattgcatcaatcttctaatgcaccaccctagactatttgaacaaagagctgtttcattcttaaacctctgtgtctccttgctaaatggtcatgctttaatgtcttcacctgtctttctcttctatagatatgtagtcttgctagatagttagttctacagctctcttttgtagtcttgttagagagttagttgagatattacctcttaaaagtatccttgaacgctttccggttatgaccaatttgttgtagctccttgtaagtagaacttactgggaccagcgagacagtttatgtgaatgttcatgcttaagtgtcgaacgtatctatctctactatagctctgtagtcttgttagacagttagttttatatctccatttttttgtagtcttgctagttgagatattacctcttctcttcaaagtatccttgaacgctcaccggttatgaaatctctacactatagctctgtagtcttgctagatagttagttctttagctctctttttgtagcctagttctttagctctccttttgtagccttgctacagagtaagatgggatattacctccttgaacgctctccggttatgaccaatttgttgtagctccttgtaagtagaacttaggatagagtgagtcaactttaagaaagaacctagtatgtggcataaccagattgcaggctctgtctcggctacagtaacgtaactctatagctctttgttttgttcagaaagaaccagtgattggatgattcgtccttagaaactggacctaacaacagtcattggctttgaaatcaagccacaacaatgcctatatgaaccgtccatttcatttatccgtttcaaaccagcccattacatttcgtcccattgataaccaaaagcggttcaatcagattatgttttaattttaccaaattctttatgaagtttaaattatactcacattaaaaggattattggataatgtaaaaattctgaacaattactgattttggaaaattaacaaatattctttgaaatagaagaaaaagcctttttccttttgacaacaacatataaaatcatactcccattaaaaagattttaatgtaaaattctgaatataagatattttttacaacaacaaccaaaaatatttatttttttccttttttacagcaacaagaaggaaaaacttttttttttgtcaagaaaaggggagattatgtaaacagataaaacagggaaaataactaaccgaactctcttaattaacatcttcaaataaggaaaattatgatccgcatatttaggaagatcaatgcattaaaacaacttgcacgtggaaagagagactatacgctccacacaagttgcactaatggtacctctcacaaaccaatcaaaatactgaataatgccaacgtgtacaaattagggttttacctcacaaccatcgaacattctcgaaacattttaaacagcctggcgccatagatctaaactctcatcgaccaatttttgaccgtccgatggaaactctagcctcaacccaaaactctatataaagaaatcttttccttcgttattgcttaccaaatacaaaccctagccgccttattcgtcttcttcgttctctagttttttcctcagtctctgttcttagatcccttgtagtttccaaatcttccgataaggcct

SEQ ID NO: 78 - DNA, 857 bp, Arabidopsis thaliana
  misc_feature: Ceres Promoter PD1367
  misc_feature (116)..(116): n is a, c, t, g, unknown, or other
  misc_feature (136)..(136): n is a, c, t, g, unknown, or other
  misc_feature (154)..(154): n is a, c, t, g, unknown, or other
  misc_feature (159)..(159): n is a, c, t, g, unknown, or other
  misc_feature (168)..(168): n is a, c, t, g, unknown, or other
  misc_feature (172)..(172): n is a, c, t, g, unknown, or other
  misc_feature (175)..(175): n is a, c, t, g, unknown, or other
  misc_feature (679)..(679): n is a, c, t, g, unknown, or other
  misc_feature (680)..(680): n is a, c, t, g, unknown, or other
  misc_feature (686)..(686): n is a, c, t, g, unknown, or other
  misc_feature (724)..(724): n is a, c, t, g, unknown, or other
  misc_feature (737)..(737): n is a, c, t, g, unknown, or other
ttggaattaattctgcggccatggggctgcaggaattcgatggcccgatcggccacagttttcttttctcatcttacaacaagtttccaggaggatagagacataaacgaagctcnggattgtatcgttctttttnagcttttattcacatccngaaangtcctgtangttntangattctgttatcttgcggttttgagttaatcagaaacagagtaatcaatgtaatgttgcaggctagatctttcatctttggaaatttgtttttttctcatgcaatttctttagcttgaccatgagtgactaaaagatcaatcagtagcaatgatttgatttggctaagagacatttgtccacttggcatcttgatttggatggttacaacttgcaagacccaattggatacttgctatgacaactccaactcaagagtgtcgtgtaactaagaaccttgactaatttgtaatttcaatcccaagtcatgttactatatgtttttttgtttgtattattttctctcctacaattaagctctttgacgtacgtaatctccggaaccaactcctatatccaccatttactccacgttgtctccaattattggacgttgaaacttgacacaacgtaaacgtatctacgtggttgattgtatgtacatatgtacaaacgtacacctttnnctcctnctttcacttcatcacttggcttgtgaattcattaattncctgcgaaggccntgcagggccatcaccactgcagtggaacaatgaagactaatctttttctctttctcatcttttcacttctcctatcattatcctcggccgaattcagtaaaggagaagaacttttcactg

SEQ ID NO: 79 - DNA, 1032 bp, Arabidopsis thaliana
  misc_feature: Ceres CLONE ID no. 8686
  misc_feature: Ceres Seed Line ID no. ME03807
  misc_feature: Encodes the peptide given in SEQ ID NO: 80
aaaaaaacactagtatcaaaaattgaacccgttaaccggcgacccgaaacaatgacccggtccgtcagtttccctctcttcctcttcgccgttgtactctccctctcttcttctctcctcgccgacgatcccaaaccaatccgccgtgaggtctacgaaggaggtaagatatacgacatcagccatcgttacacgccggagattccagcttgggaatcttcggaaggattgggaaagacgttcctgcgattagccgcgagtatgaagaatggatcattcgctaacgtatcggagatgaaactatctgttcactctggaactcacgtggatgctccaggtcacttttgggataattattacgatgctggttttgatactgattcgcttgatctccaagtcctaaatggtcctgctttgttggttgatgttccgagagataagaacattactgctgaggtaatggaatcacttcatatacaaagaggagttcgtcgtgtgctctttagaacatccaacaccgacaagcggcttatgtttaagaaagagtttgattcaagctttgctgggttcatgaccgatggggctaaatggttggttgagaatacagacatcaaacttattgggcttgattatctttcatttgctgcttttgaggaatcacctgcaacacacagggttatacttaaaggacgggatataatcccagtggaagcgctgaagctggatggtgtggaggtaggaacatactcgcttcattgcttaccgctgagattagttggagcggaaggagcaccgacaagatgcattctcatcaagtgattcagttcttcttcttcttcttcttcttctgtgtaagttgttcagtataccaaactgataatgaataatatgcttcttactttacaagatctcagaacccatgaagcagatgtgatgattcagttgtaaaaggaagcatacctttataaacgtgtgaatgtattatgtatgacagtatatttgtaattctgaaggacatgataataaacctag

SEQ ID NO: 80 - protein, 255 aa, Arabidopsis thaliana
  misc_feature: Ceres CLONE ID no. 8686
  misc_feature: Ceres Seed Line ID no. ME03807
  misc_feature (40)..(241): Pfam Name: Cyclase Pfam Description: Putative cyclase
MTRSVSFPLFLFAVVLSLSSSLLADDPKPIRREVYEGGKIYDISHRYTPEIPAWESSEGLGKTFLRLAASMKNGSFANVSEMKLSVHSGTHVDAPGHFWDNYYDAGFDTDSLDLQVLNGPALLVDVPRDKNITAEVMESLHIQRGVRRVLFRTSNTDKRLMFKKEFDSSFAGFMTDGAKWLVENTDIKLIGLDYLSFAAFEESPATHRVILKGRDIIPVEALKLDGVEVGTYSLHCLPLRLVGAEGAPTRCILIK

SEQ ID NO: 81 - protein, 204 aa, Brassica napus
  misc_feature: Ceres CLONE ID no. 1096546
  misc_feature (1)..(185): Pfam Name: Cyclase Pfam Description: Putative cyclase
  misc_feature (1)..(204): Functional Homolog of  Ceres CLONE ID no. 8686 at SEQ ID NO. 80 with e-value of 8.19E-91 and BLAST sequence identity of 87.2
  misc_feature (88)..(88): Xaa is any aa, unknown, or other
  misc_feature (99)..(99): Xaa is any aa, unknown, or other
  misc_feature (134)..(134): Xaa is any aa, unknown, or other
  misc_feature (152)..(152): Xaa is any aa, unknown, or other
  misc_feature (171)..(171): Xaa is any aa, unknown, or other
  misc_feature (194)..(194): Xaa is any aa, unknown, or other
  misc_feature (196)..(196): Xaa is any aa, unknown, or other
  misc_feature (200)..(200): Xaa is any aa, unknown, or other
MPAWESKEGLSNHLRLIASMKNGSFANVSEMKLSVHSGTHVDAPGHFIDEYYDAGFDCDSLDLQTLNGPALLVDVPRDKNITAEVMEXLHIPRGVRRVXFRTSNTDKRLMFKKEFDSSFSGFMTDGAKWLVENXDIKLVGLDYLSFAAFDEXPATHKVILRGRDIIPVEAXKLDGVEAGMYSLHCLPLRLVGAXGXPTRXILIK

SEQ ID NO: 82 - protein, 157 aa, Brassica napus
  misc_feature: Ceres CLONE ID no. 1311812
  misc_feature (1)..(157): Functional Homolog of  Ceres CLONE ID no. 8686 at SEQ ID NO. 80 with e-value of 2.60E-64 and BLAST sequence identity of 86.7
  misc_feature (13)..(141): Pfam Name: Cyclase Pfam Description: Putative cyclase
MDKVLTNAGFDSDSLDLQVLHGPALLVDVPRDKNITXVMKSLHIPKGVRRVLFRTLNXDRRLMFKKEFDSSFAGFMMDGAKWLVENTDIKLIGLDYLSFAAYEEAPETHKFILGERDIIPVEALKLDGVEVGVYSLHCLPLRLPGAEGAPTRCILIK

SEQ ID NO: 83 - protein, 204 aa, Brassica napus
  misc_feature: Ceres CLONE ID no. 952461
  misc_feature (1)..(204): Functional Homolog of  Ceres CLONE ID no. 8686 at SEQ ID NO. 80 with e-value of 1.79E-88 and BLAST sequence identity of 85.7
  misc_feature (1)..(182): Pfam Name: Cyclase Pfam Description: Putative cyclase
MPAWESKEGLSNHLRLIASMKNGSFANVSEMKLSVHSGTHVDAPGHFIDEYYDAGFDCDSLDLQTLNGPALLVDVXXXKNITAEVMEXLHIPRGVRRVXFRTSNTDKRLMFKKEFDSSFSGFMTDGAKWLVENXDIKLVGLDYLSFAAFDEXPATHKVILRGRDIIPVEAXKLDGVEAGMYSLHCLPLRLVGAXGXPTRXILIK

SEQ ID NO: 84 - protein, 233 aa, Brassica napus
  misc_feature: Ceres CLONE ID no. 954851
  misc_feature (1)..(233): Functional Homolog of  Ceres CLONE ID no. 8686 at SEQ ID NO. 80 with e-value of 4.70E-95 and BLAST sequence identity of 80.4
  misc_feature (20)..(216): Pfam Name: Cyclase Pfam Description: Putative cyclase
MTSSDDLKPIRQEVYGERKIFDITHRYTQDMPVWESTEGVKPFLRLTTSMKNQSLSNTSEMKLSVHTGTHLDAPGHFHDKYYDAGFDSDSLDLQVLHGPALLVDVPRDKNIXXVMKSLHIPKGVRRVLFRTLNXDRRLMFKKEFDSSFAGFMMDGAKWLVENTDIKLIGLDYLSFAAYEEAPETHKFILGERDIIPVEALKLDGVEVGVYSLHCLPLRLPGAEGAPTRCILIK

SEQ ID NO: 85 - protein, 271 aa, Zea mays
  misc_feature: Ceres CLONE ID no. 1064137
  misc_feature (1)..(271): Functional Homolog of  Ceres CLONE ID no. 8686 at SEQ ID NO. 80 with e-value of 1.00E-90 and BLAST sequence identity of 75.2
  misc_feature (57)..(257): Pfam Name: Cyclase Pfam Description: Putative cyclase
MAVPPLLLLTLLSLPSLLIHAAISDAYPTIPGTAPIDGGFSDELKPIRREVYGEGKIFDISHRYTPEMPAWESKEGIGRFLWLAASMKNGSLANNSEMKIPTHTGTHVDSPGHVYDEYYDAGFDVDSLDLQVLNGPALLVDVPRNKNITAEVMKSLNIPRGVRRVLFRTLNTDRRLMFKKEFDTSYVGFMKDGAQWLVDNTDIKLVGVDYLSVAAYDDLIPSHLVFLKGRETILVEGLKLDDVKAGVYSVHCLPLRLVGAEGSPIRCILIS

SEQ ID NO: 86 - protein, 121 aa, Zea mays
  misc_feature: Ceres CLONE ID no. 368629
  misc_feature (1)..(121): Functional Homolog of Ceres CLONE ID no. 8686 at SEQ ID NO. 80 with e-value of 9.09E-37 and BLAST sequence identity of 72.8
  misc_feature (1)..(103): Pfam Name: Cyclase Pfam Description: Putative cyclase
MPEWESSEGSGEFLQLARSMRNGSDIANFSELRLTAHSGTHVDAPGHVFEHYYDTGFDVDTLDLAVLNGPALLVDVPRDKNITADVMASLNMPKGVRRVLFRTLNTDRMVHNGWLIIQTSN

SEQ ID NO: 87 - protein, 205 aa, Glycine max
  misc_feature: Ceres CLONE ID no. 473732
  misc_feature (1)..(205): Functional Homolog of  Ceres CLONE ID no. 8686 at SEQ ID NO. 80 with e-value of 3.60E-74 and BLAST sequence identity of 71.2
  misc_feature (1)..(191): Pfam Name: Cyclase Pfam Description: Putative cyclase
MPVWDSTEGLGQHFLWLEKSMKNGSRANNSNMKLGVHTGTHVDAPGHFYDNYYDAGFDVDSLDLTLLNGLALLVDVPRDKNITAEVMKSLNIPRGVSRVLFRTLNTDRQLMFKKEFDTSYVGFKEDGAKWLAENTDIKLVGVDYLSVAAYDHSIPSHLVFLESKEIILVEGLKLDDVPAGIYSLNCLPLRLVHSEASPIRCILIK

SEQ ID NO: 88 - DNA, 831 bp, Populus balsamifera subsp. trichocarpa
  misc_feature: Ceres ANNOT ID no. 1441150
  misc_feature: Encodes the peptide given in SEQ ID NO. 89
atggcatccctcctcttgttactgctcctgtctcccctctccaccaccgcagcctccagcggcgcttaccccaccatccctggcagcatagacacctctttccccgcttcacaagacagcaaacttatcccaatcaggcgtgaggtgtatggtgatgggagaatatttgacataacccacaggtacacaagcgacatgccgtccatgggatcagaaaatgggctgggtcagttcctgaggctccctgaaagcatgaagaatgggtccttcgccaacatatcggagatgaagttgatcactcatactggcacacacgtcgatgcacctggacattactatgatcattacttcgatgctgggtttgatgtggacactcttgaccttgaagtacttaatggtcctggactattaattgatgttccaagggggacgaacataactgctgaagttatgaagtccttacatattcccaaaggagctcgacgtgttcttttcaggacagaaaataccgacaggcgacttatgttcaaaaatcagatcgatacaagctttgtgggatttacaacggatggagcaaaatggttggtagacaacactgacattaagcttgttggaattgattacttagctgttgctgcttggagtgatttggttccagctcatcttgtccttttggaaagcagggtgagactaatgcagtgtaaagaaatcatcattgtggaaggcctaaaactcgatgacatccaacctggtgtgtattctatccattgtttgcctataagattgctcggtgctgaaggatcaccaacgcgatgcattctcatcaaatga

SEQ ID NO: 89 - protein, 211 aa, Populus balsamifera subsp. trichocarpa
  misc_feature: Ceres ANNOT ID no. 1441150
  misc_feature (1)..(211): Functional Homolog of  Ceres CLONE ID no. 8686 at SEQ ID NO. 80 with e-value of 2.30E-72 and BLAST sequence identity of 68.6
  misc_feature (13)..(197): Pfam Name: Cyclase Pfam Description: Putative cyclase
MPSMGSENGLGQFLRLPESMKNGSFANISEMKLITHTGTHVDAPGHYYDHYFDAGFDVDTLDLEVLNGPGLLIDVPRGTNITAEVMKSLHIPKGARRVLFRTENTDRRLMFKNQIDTSFVGFTTDGAKWLVDNTDIKLVGIDYLAVAAWSDLVPAHLVLLESRVRLMQCKEIIIVEGLKLDDIQPGVYSIHCLPIRLLGAEGSPTRCILIK

SEQ ID NO: 90 - protein, 251 aa, Glycine max
  misc_feature: Ceres CLONE ID no. 554272
  misc_feature (1)..(251): Functional Homolog of  Ceres CLONE ID no. 8686 at SEQ ID NO. 80 with e-value of 1.90E-75 and BLAST sequence identity of 68.0
  misc_feature (37)..(237): Pfam Name: Cyclase Pfam Description: Putative cyclase
MNCYWWHALIMSGCVLGLCVGIGGCVCVVENENGRIIIDISHRYHPDMPAWESKDSLGQFLWLTRSMANGSLANFSQFKLPAHSGTHVDAPGHVFDHYFHSGFDVDSLDLLLLNGPALLVDVPRDTNISAGVMKSLNIPRGVRRVLFRTLNTYRRLMYQKEFDTSYVGFTEDGANWLVENTDIKLVGIDYLSVAAYDHLIPAHLVFLKGREIILVEGLKLDDVAAGIYTVHCLPLRLAGAEGSPIRCILIK

SEQ ID NO: 91 - protein, 255 aa, Glycine max
  misc_feature: Ceres CLONE ID no. 511015
  misc_feature (1)..(255): Functional Homolog of  Ceres CLONE ID no. 8686 at SEQ ID NO. 80 with e-value of 1.40E-81 and BLAST sequence identity of 66.3
  misc_feature (40)..(240): Pfam Name: Cyclase Pfam Description: Putative cyclase
MKRGALLSVLACAFAAVIWAANGDDNLVPPRREVYGNGRIFDISHRYQPEMPEWESNDGIGQFLWLPKSMKNGSLANNSEMKFPTHTGTHVDAPGHVFDHYFHAGFDVDTLDLDILNGPAMLVDVPRDSNITAQVMKSLNIPRGVIRVLFRTLNTDRRLMFQKEWDSSYVGFTADGAKWLVENTDIKLVGIDYLSVASYDYLIPSHLVFLKDREIILVEGLKLDDVPAGLYSVHCLPLRLAGAEGSPIRCILIKN

SEQ ID NO: 92 - protein, 265 aa, Triticum aestivum
  misc_feature: Ceres CLONE ID no. 881632
  misc_feature (1)..(265): Functional Homolog of  Ceres CLONE ID no. 8686 at SEQ ID NO. 80 with e-value of 2.10E-78 and BLAST sequence identity of 66.3
  misc_feature (51)..(251): Pfam Name: Cyclase Pfam Description: Putative cyclase
MAPPLLLLLLVPLVAATAPCAHPAHPSQPASCAAEPVLAPERREAHGGGRILDITHYYREDMPSWESGAGVGQFLWLPASMRNGSLANNSEMRMPTHTGTHIDASGHVFQHYFDAGFDVDTLDLDVLNGPALLVDVPRDENITAKTMESLHIPKGVQRVLFRTLNTDRNLMWKKEFDTSYVGFMKDGAQWLVDNTDIKLVGIDYLSVAAFDDLIPSHLVLLENRDIILVEGLKLENVIPGIYSLHCLPLRLRGAEGSPIRCILIK

SEQ ID NO: 93 - protein, 269 aa, Oryza sativa subsp. japonica
  misc_feature: Public GI no. 50944095
  misc_feature (1)..(269): Functional Homolog of  Ceres CLONE ID no. 8686 at SEQ ID NO. 80 with e-value of 1.40E-79 and BLAST sequence identity of 66.2
  misc_feature (55)..(255): Pfam Name: Cyclase Pfam Description: Putative cyclase
MAHLAPLFLLLLLLLLPLHAAATPSAHPAYPNEPPSCAAAVPVPERREAHGGGRILDITHYYREDMPSWESDGGVGQFLWLPASMRNGSRANNSEMRLPTHTGTHVDAPGHVFQHYFDAGFDVDSLDLEVLNGLALLVDVPRDDNITAKMMESLHIPKGIQRVLFRTLNTDRQLMWKKEFDTSYVGFMEDGAQWLVDNTDIKLVGIDYLSVAAFDDLIPSHLVLLKNRDIILVEGLKLENIMPGIYSLHCLPLRLRGAEGSPIRCILIK

SEQ ID NO: 94 - DNA, 825 bp, Populus balsamifera subsp. trichocarpa
  misc_feature: Ceres ANNOT ID no. 1494052
  misc_feature (1)..(825): Encodes the peptide given in SEQ ID NO. 95
atgtccaccaccaaaaccatgatccctctcctcctcctcctcctcctctctcccctctccaccaccgcttctaccgccgcctaccccacaatcccgggcaccatagacacctcagtctcctcctcccaacccgacaacctgattccaatccgcaacgaaatctacggcaatggtaaaatctttgacataagtcacagatacataaacgatatgccggtttgggactctaaagacgggttgggaaagttcctgtctttaccagcaagcatgaaaaatgggtctctcgctaacaactcagaaatgaagttacctactcatactggcacgcatgttgactcacctggacatgtttttgatcattactttgattctgggttcgatgttgatactcttgatcttgaagtccttaatggtcctgctttgctagtggatgttccaaggcattccaatataactgctgaagttatgaagtccttacacattccaaagggagtgcgtcgcgtgcttttcagaacactaaacactgacaggcggcttatgttcaaaagggagtttgatagaagttatgtggggttcacaaaggatggtgcaaaatggttggtagacaacactgacatcaagcttgttggaattgattacctatctgttgctgcctggagtgatttgattccatctcatcttgtctttctagaaggcagggaaatcatccttgtggaggctttaaaactggatgacatccaacctggagtatattctgtccattgtttacccctgaggttgtttggcgccgagggatctccaataagatgcgttctcatcaaatga

SEQ ID NO: 95 - protein, 274 aa, Populus balsamifera subsp. trichocarpa
  misc_feature: Ceres ANNOT ID no. 1494052
  misc_feature (1)..(274): Functional Homolog of  Ceres CLONE ID no. 8686 at SEQ ID NO. 80 with e-value of 4.30E-85 and BLAST sequence identity of 65.6
  misc_feature (60)..(260): Pfam Name: Cyclase Pfam Description: Putative cyclase
MSTTKTMIPLLLLLLLSPLSTTASTAAYPTIPGTIDTSVSSSQPDNLIPIRNEIYGNGKIFDISHRYINDMPVWDSKDGLGKFLSLPASMKNGSLANNSEMKLPTHTGTHVDSPGHVFDHYFDSGFDVDTLDLEVLNGPALLVDVPRHSNITAEVMKSLHIPKGVRRVLFRTLNTDRRLMFKREFDRSYVGFTKDGAKWLVDNTDIKLVGIDYLSVAAWSDLIPSHLVFLEGREIILVEALKLDDIQPGVYSVHCLPLRLFGAEGSPIRCVLIK

SEQ ID NO: 96 - DNA, 1005 bp, Populus balsamifera subsp. trichocarpa
  misc_feature: Ceres ANNOT ID no. 1441151
  misc_feature: Encodes the peptide given in SEQ ID NO. 97
atgtccaccaccaaaaccatgatccctctcctcctcctcctcctcctctctcccctctccaccaccgcttctaccgccgcctaccccacaatcccgggcaccatagacacctcagtctcctcctcccaacccgacaacctgattccaatccgcaacgaaatctacggcaatggtaaaatctttgacataagtcacagatacataaacgatatgccggtttgggactctaaagacgggttgggaaagttcctgtctttaccagcaagcatgaaaaatgggtctctcgctaacaactcagaaatgaagttacctactcatactggcacgcatgttgactcacctggacatgtttttgatcattactttgattctgggttcgatgttgatactcttgatcttgaagtccttaatggtcctgctttgctagtggatgttccaaggcattccaatataactgctgaagttatgaagtccttacacattccaaagggagtgcgtcgcgtgcttttcagaacactaaacactgacaggcggcttatgttcaaaagggagtttgatagaagttatgtggggttcacaaaggatggtgcaaaatggttggtagacaacactgacatcaagcttgttggaattgattacctatctgttgctgcctggagtgatttgattccatctcatcttgtctttctagaaggcagggaaatcatccttgtggaggctttaaaactggatgacatccaacctggagtatattctgtccattgtttacccctgaggatcctttattcacacttgttcaatgctgctaccagctcacatgccacaccatggcacaacaggcaagatacaatctaccacaacaaaagcctactgtttatcccacgtgaattgtctggtcagaaaggatcacaaacagaggccagtgactcaaatttaggcgggcgcttcattgactggcaagtggcaacagaaaccttccacgacccaggatcagtgcttgtatag

SEQ ID NO: 97 - protein, 334 aa, Populus balsamifera subsp. trichocarpa
  misc_feature: Ceres ANNOT ID no. 1441151
  misc_feature (1)..(334): Functional Homolog of  Ceres CLONE ID no. 8686 at SEQ ID NO. 80 with e-value of 6.10E-79 and BLAST sequence identity of 64.5
  misc_feature (60)..(260): Pfam Name: Cyclase Pfam Description: Putative cyclase
MSTTKTMIPLLLLLLLSPLSTTASTAAYPTIPGTIDTSVSSSQPDNLIPIRNEIYGNGKIFDISHRYINDMPVWDSKDGLGKFLSLPASMKNGSLANNSEMKLPTHTGTHVDSPGHVFDHYFDSGFDVDTLDLEVLNGPALLVDVPRHSNITAEVMKSLHIPKGVRRVLFRTLNTDRRLMFKREFDRSYVGFTKDGAKWLVDNTDIKLVGIDYLSVAAWSDLIPSHLVFLEGREIILVEALKLDDIQPGVYSVHCLPLRILYSHLFNAATSSHATPWHNRQDTIYHNKSLLFIPRELSGQKGSQTEASDSNLGGRFIDWQVATETFHDPGSVLV

SEQ ID NO: 98 - DNA, 1888 bp, Artificial Sequence
  misc_feature: Ceres CDNA ID no. 23799376
  misc_feature: Ceres Clone ID no. 375578
  misc_feature: Ceres Seed Line ID no. ME02064
  misc_feature: Encodes the peptide given in SEQ ID NO. 99
  misc_feature: Encodes the peptide given in SEQ ID NO. 180
cccggtttattttttcttcgtcctggatgcgtcggtcgcgtgtttgatctgactaagccgcggaggagggtgctagatgtccgtgcggtgggcggtggctcccgagggcgaccggagttaggtccttgccgccttcagtgcggtggggaagcgagacattgaaggcgcagaacccaaagaatgggtaagagaggaaagtggtttagtgcggtgaagaaagtcttcagctcctccgatccagatggaaaggaagccaaggcccagaaggcagacaaatcgaaatccaagaggagatggccatttggaaagtccaagcactcggagccttccatatcgacggtgccaggcactgctccagcagtagctccgttgccatcaccaccagcaactcagccccactctctggagatcaaagatgtcaatccagttgaaacagacagtgagcagaacaagcatgcctactccgttgcgcttgcgtctgctgtcgctgctgaagctgcagcagttgctgcccaggctgctgcggaagttgtccgcctcacagcagttaccacggctgcaccaaagatgcctgttagttcgagggaataacttgccgccaccaagattcagactgccttcaggggttatctggcaaggagagcattgcgtgcactaagagggctagttagattgaagtcgcttgttgatggaaatgctgtcaaacgccaaaccgctcacaccttgcaatgcacacaagcaatgacaagagttcaaactcaaatctactctagaagggtgaagttggaggaggagaaacaggctcttcaaagacaactccaattgaaacatcaaagggaacttgagaaaatgaagattgatgaagattgggatcacagccatcaatccaaagagcaaattgaggccaacctaatgatgaaacaggaagctgcactgaggcgagagagagcacttgcatatgcattttctcaccagtggaggaattctggtcgaactataacccctacttttacggaacctgggaaccccaactggggctggagctggatggagcgctggatgacagcaagaccatgggagagtcggttggcggcggcatcggacaaggaccctaaagaacgtgctgtgacaaagaatgcgagcaccagtgctgttcgagtacctgtatcccgtgccatctcgattcagagaccagcaacaccaaacaagtcgagccgcccaccaagccggcagtcactttcaaccccgccatcgaagaccccgtcagcctcaggaaaggccaggccggcaagtccaaggaacagttggctgtacaaggaggatgacctgaggagcatcacgagcatccgctccgagcgcccaaggaggcagagcacgggtggaggctcggtccgggacgataccagcctgaccagcacaccacctctccccagctacatgcagtcgaccgagtctgcacgggccaagtctcggtaccgcagtctactactgactgagaagcttgaggttcctgagagagcgcctctggcccactccgttgtcaagaagcgcctgtcgttccccgtcgtcgagaagccaagcgttgtgccgacagagaagcccagggaaagagtgaggcgccattccgaccctccgaaggtcgatcctgcgacgctcaaggatgcccctgctgcctgaccagtgaccaggccttatgtgattgttaggtttcgtgctcttttaacaccgtgatgtattatctgagttaggttgctttgttcgtgtcatcgtatgatctgtccgggttgattttgagacagttctaactgtgtttacagacaatgcgtgatgctaaatgtatgtgtggttggttggctttaaatgtactgatatgatagtatttgatttc

SEQ ID NO: 99 - protein, 311 aa, Artificial Sequence
  misc_feature: Ceres CDNA ID no. 23799376
  misc_feature: Ceres Clone ID no. 375578
  misc_feature: Ceres Seed Line ID no. ME02064
MTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 100 - protein, 500 aa, Oryza sativa subsp. japonica
  misc_feature: Public GI no. 56202321
  misc_feature (1)..(500): Functional Homolog of Ceres Clone ID no. 375578 at SEQ ID NO. 252 with e-value of 2.59E-135 and BLAST sequence identity of 83.4
  misc_feature (142)..(162): Pfam Name: IQ Pfam Description: IQ calmodulin-binding motif
MGKKGNWFSAVKKVFSSSDPDGREAKIEKADKSRSRRKWPFGKSKKSDPWTSTVAVPTSTAPPPQPPPPPPTHPIQPQPEEIKDVKAVETDSEQNKHAYSVALASAVAAEAAAVAAQAAAEVVRLTTATTAVPKSPVSSKDELAAIKIQTAFRGYLARRALRALRGLVRLKSLVDGNAVKRQTAHTLHCTQTMTRVQTQIYSRRVKMEEEKQALQRQLQLKHQRELEKMKIDEDWDHSHQSKEQVETSLMMKQEAALRRERALAYAFSHQWKNSGRTITPTFTDQGNPNWGWSWMERWMTSRPWESRVISDKDPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

SEQ ID NO: 101 - DNA, 1470 bp, Populus balsamifera subsp. trichocarpa
  misc_feature: Ceres ANNOT ID no. 1465047
  misc_feature: Encodes the peptide given in SEQ ID NO. 102
atggggaaaagagggagttggttctctgctttgaagaaagccctcggttcctctaagaaatccaaatcaaagaagaaatggtcagaaaaagagaagaaccgggatctaggtgtttcttcacatgaagaaaccgttgcaccctctctttctcctcctcgtacaccacctcctcctacagcagaagatgtgaaattaactgaagctgagaacgagcagagcaagcatgcttattccgtggcgcttgccactgctgtggcagctgaggcagctgttgcagccgcccaggctgccgctgaggttgttcggcttactacagtggcacattactctggaaaatcgaaggaggaaatagctgcaatcaggattcaaacagcatttagaggatacctggcgaggagggcattacgtgctttgagagggctggtgagattgaagtcattgatacaagggcaatctgtcaaacggcaagcaactgccacattacgagccatgcagactcttgctcgtgtgcagtctcagattcgtgcaagaaggatcagaatgtccgaggaaaatgaggccctccaacggcagctccagcagaaacatgacaaagaacttgagaagttgagaacttctattggagaacaatgggatgatagcccacaatcaaaggaagaagttgaagccagcctactacaaaagcaagaagctgccatgagaagagaaagggcactggcttatgcatactcgcatcagcaaatgtggaagcaatcttcaaaatcagcaaatgctacattcatggatccaaacaatcctcgttggggatggagttggttagagaggtggatggcagcccgaccttgggagagccgaagcacaatagataacaatgatcgggcctctgttaagagtacaacaagccgtaccatgtctcttggagaaatcagcagagcttattctcgtcgtgatcttaaccatgacaataaagcttctcctggtgcgcaaaaatcaagtcggcctcccagtcggcaatcaccttctactcccccctctaaggcaccatctacatcttcagtaacagggaaagcaaagccaccaagccctagagggagtgcttggggaggagacgaggactccaggagcacattcagtgtccagtctgagcgctatcggagacatagcatagcagggtcatcaataagagatgatgagagtcttgcaagttcgccttcagttccaagttacatggcacccacacggtcacagtcagcaaaggcaaaatcccgcttgtcaagcccgttaggcatagataataatgggacaccagataaggcatcagtgggttatgtaaagaagcggctttccttctctgcttcaccagctggagcaaggagacactctggtcctcctagggtggatgccagtgctgttaaagacattcaaatgcacagagaagagaaaatgagcaatggagcaagcagcaagtag

SEQ ID NO: 102 - protein, 489 aa, Populus balsamifera subsp. trichocarpa
  misc_feature: Ceres ANNOT ID no. 1465047
  misc_feature (1)..(489): Functional Homolog of Ceres Clone ID no. 375578 at SEQ ID NO. 252 with e-value of 3.29E-71 and BLAST sequence identity of 56.8
  misc_feature (116)..(136): Pfam Name: IQ Pfam Description: IQ calmodulin-binding motif
MGKRGSWFSALKKALGSSKKSKSKKKWSEKEKNRDLGVSSHEETVAPSLSPPRTPPPPTAEDVKLTEAENEQSKHAYSVALATAVAAEAAVAAAQAAAEVVRLTTVAHYSGKSKEEIAAIRIQTAFRGYLARRALRALRGLVRLKSLIQGQSVKRQATATLRAMQTLARVQSQIRARRIRMSEENEALQRQLQQKHDKELEKLRTSIGEQWDDSPQSKEEVEASLLQKQEAAMRRERALAYAYSHQQMWKQSSKSANATFMDPNNPRWGWSWLERWMAARPWESRSTIDNNDRASVKSTTSRTMSLGEISRAYSRRDLNHDNKASPGAQKSSRPPSRQSPSTPPSKAPSTSSVTGKAKPPSPRGSAWGGDEDSRSTFSVQSERYRRHSIAGSSIRDDESLASSPSVPSYMAPTRSQSAKAKSRLSSPLGIDNNGTPDKASVGYVKKRLSFSASPAGARRHSGPPRVDASAVKDIQMHREEKMSNGASSK

SEQ ID NO: 103 - protein, 367 aa, Glycine max
  misc_feature: Ceres CLONE ID no. 474985
  misc_feature (1)..(367): Functional Homolog of Ceres Clone ID no. 375578 at SEQ ID NO. 252 with e-value of 1.39E-63 and BLAST sequence identity of 52.4
  misc_feature (11)..(31): Pfam Name: IQ Pfam Description: IQ calmodulin-binding motif
MPHYTGRTKEEIAAIKVQTAFRGYMARRALRALRGLVRLKTLVQGQSVKRQAASTLRSMQTLARLQSQIRERRIRMSEENQALQRQLHQKHEKELEKLRAAVGEEWDDSSQSKEQIEAKLLHRQEAALRRERALAYSFSHQQTWKGSSKSLNPTFMDPNNPQWGWSWLERWMATRPWDGHSTVVDHNDHASVKSAASRAVSVGQITKLYSLQDKKPSPFGSKARRPAPQSSHSKAPSTNGKARPSSSTKGSSVWGGDEDSRSMFSVQSERYRRHSIAGSSVRDDDSRASTPAIPSYMAATSSAKARSKIIRHSPEKKGGGGSVSARKRLSFSPSSAANSRRHSDPPKVEMVYNKDAAAATVSNGRGR

SEQ ID NO: 104 - protein, 378 aa, Triticum aestivum
  misc_feature: Ceres CLONE ID no. 826796
  misc_feature (1)..(378): Functional Homolog of Ceres Clone ID no. 375578 at SEQ ID NO. 252 with e-value of 5.20E-57 and BLAST sequence identity of 50.3
  misc_feature (4)..(24): Pfam Name: IQ Pfam Description: IQ calmodulin-binding motif
MSRELAATKIQTAFRGHLARRALRALKGLVRLKSLVQGHSVKRQATSTLRCMQTLSRVQSKIRTRRIKMAEENQALQRQLLLNQELETLRMGDQWNTSLQSKEQIEASLVSRQEAAARRERALAYAFSHQWKSTSRSANPMFVDPSNPHWGWSWLERWMASRPFDGRNGASEKEGSSVDRTSVHSTSLSMNLGEGETVTKADNQVVDSLKPNDDKPPPLSTPKPSGPAPRQSPSTPSPALARKKSATPKSGDCDGDDARSVVSTVRSERPRRHSIGASSVRDDAGSSPSVPSYMAATKSASARAKSRVQSPTLTEGAAQAETLEKGWSSVGSAKKRLSFPAGTPPPVPAAAARRHSGPPKVRQAGVEGGTEERDSSLA

SEQ ID NO: 105 - DNA, 1366 bp, Arabidopsis thaliana
  misc_feature: Ceres CDNA ID no. 23363195
  misc_feature: Ceres Clone ID no. 105319
  misc_feature: Ceres Seed Line ID no. ME04074
  misc_feature: Encodes the peptide given in SEQ ID NO. 106
aaattgttgtcttttaggttttgacagtagcaaagaaaagctgaatctagttagaaattgcttttgcagggtttttgaatagtttgtgtattgaagattgtctgaaatggaagcagctattactcagaggattcagtacccatcatgggttgattgtagaaaagttgagtgtaagccgcagcgtggttcattgcggtattctcagcaggttaaggtagatagaaggtttagaggtctttctttggctcgcttgcaacctgaaagaagaattgatcaacgaagagcagtttctccagcggtttcctgttctgataacaattcctcagcgttgttggagactggaagtgtttatccatttgatgaagatattctcaagagaaaagcagaagaggttaaaccgtatttgaatggacgatctatgtaccttgtcggaatgatgggttctgggaaaacaactgtgggaaagttaatgtccaaagtgctcggttatacgttctttgactgcgacactttgattgaacaggcgatgaatggaacttctgttgcagagatatttgttcatcacggagagaatttttttagaggaaaggagaccgatgcgcttaagaagctctcttcgaggtatcaagttgttgtttccacaggtggaggtgcagttataagacccattaactggaagtatatgcataaaggaatcagcatttggctagatgtgcctctagaagcattagcccatagaatcgctgctgttggaactgattcacgaccactgctacacgatgaatcaggagatgcatactcagtggctttcaaacgtctctcggctatttgggacgagcgcggtgaagcatacacaaacgcaaatgccagagtctccttagaaaatattgcagcaaagcgtggctataaaaatgtctcagatctcacaccaactgaaatttgtatcgaggccttcgagcaagttctgagctttctagagaaagaagaaactatggagatcccagacggcgacctctaatttcccagccttctgttctccgtctcttcatttatctgtttaatcaactaaacgaagcaatcactcatcaccaggccattgagcaagttcagagacaaagaagacctctagttactggttccgggtcattggagcttacacgagcctaattttgactggaactatggtttattgaaagaagattcaatacatgtatatataaaatatatacttttttttttgtttcagtatcatccttcttctcttttccttacaataagaattaaggaaaagtagccgtgtttgttaacatgggccaagaacaagcaaagtgatcattcaaatataaaagtagctttctcatggaat

SEQ ID NO: 106 - protein, 303 aa, Arabidopsis thaliana
  misc_feature: Ceres CDNA ID no. 23363195
  misc_feature: Ceres Clone ID no. 105319
  misc_feature: Ceres Seed Line ID no. ME04074
  misc_feature (111)..(287): Pfam Name: SKI Pfam Description: Shikimate kinase
MEAAITQRIQYPSWVDCRKVECKPQRGSLRYSQQVKVDRRFRGLSLARLQPERRIDQRRAVSPAVSCSDNNSSALLETGSVYPFDEDILKRKAEEVKPYLNGRSMYLVGMMGSGKTTVGKLMSKVLGYTFFDCDTLIEQAMNGTSVAEIFVHHGENFFRGKETDALKKLSSRYQVVVSTGGGAVIRPINWKYMHKGISIWLDVPLEALAHRIAAVGTDSRPLLHDESGDAYSVAFKRLSAIWDERGEAYTNANARVSLENIAAKRGYKNVSDLTPTEICIEAFEQVLSFLEKEETMEIPDGDL

SEQ ID NO: 107 - protein, 249 aa, Glycine max
  misc_feature: Ceres CLONE ID no. 463638
  misc_feature (1)..(249): Functional Homolog of  Ceres CLONE ID no. 105319 at SEQ ID NO. 106 with e-value of 2.29E-79 and BLAST sequence identity of 66.6
  misc_feature (60)..(236): Pfam Name: SKI Pfam Description: Shikimate kinase
MMRRRTTALEVSCSYGNISASILESGSVRAPLDEELILKNRSQEIQPYLNGRCIYLVGMMGSGKTTVGKIMSQVLGYSFCDSDALVEEEVGGNSVADIFKQHGETFFRNKETEVLHKLSLMHQLVISTGGGAVTRPINWKYMHKGVSVWLDVPVEALAQRIAAVGTNSRPLLHYEAGDPYTRAFMRLSALFEERGEAYANANARVSLKNIAIKLGKRDVSELSPTDIAIEALEQIDNFLKGEGGRYAEC

SEQ ID NO: 108 - DNA, 570 bp, Populus balsamifera subsp. trichocarpa
  misc_feature: Ceres ANNOT ID no. 1504048
  misc_feature: Encodes the peptide given in SEQ ID NO. 109
atgatgggctctggaaaaacaacagtgggaaagattctctcgcaagcaattcattattcattctgtgacagtgacacattggtggagaaggatgttggtgtgacttctgtagctgaaatatttcaaatatatggagaggatttcttcagagataaagagactgaggcattagaaaagctatcactagagcaccgatatgtcgtttctactggtggaggtgctgtgatacaggatgaaaactggacgtacatgaggaaggggattagtgtctggttagatgtgcctttggaagaattggcacagaggattgcggctgtaggaaccaagactcgcccccttttggatagagaaccaggagatgcatacaccaaggcgttcaggcgtctgtctgctctgtttgaacagagatataaagcttatgaaaatgctaatgcaagggtttctctggaaaatattgcagccaaattaggatataaagatgtatccaatatcacaccacctatgattgcgattgagaacatggcttgggtgatgcattacgcagcaggtttccgtctattaccagtgtaa

SEQ ID NO: 109 - protein, 188 aa, Populus balsamifera subsp. trichocarpa
  misc_feature: Ceres ANNOT ID no. 1504048
  misc_feature (1)..(188): Functional Homolog of  Ceres CLONE ID no. 105319 at SEQ ID NO. 106 with e-value of 5.40E-55 and BLAST sequence identity of 64.2
  misc_feature (1)..(177): Pfam Name: SKI Pfam Description: Shikimate kinase
MGSGKTTVGKILSQAIHYSFCDSDTLVEKDVGVTSVAEIFQIYGEDFFRDKETEALEKLSLEHRYVVSTGGGAVIQDENWTYMRKGISVWLDVPLEELAQRIAAVGTKTRPLLDREPGDAYTKAFRRLSALFEQRYKAYENANARVSLENIAAKLGYKDVSNITPPMIAIENMAWVMHYAAGFRLLPV

SEQ ID NO: 110 - protein, 189 aa, Zea mays
  misc_feature: Ceres CLONE ID no. 1565097
  misc_feature (1)..(189): Functional Homolog of  Ceres CLONE ID no. 105319 at SEQ ID NO. 106 with e-value of 3.00E-29 and BLAST sequence identity of 64.0
  misc_feature (100)..(173): Pfam Name: SKI Pfam Description: Shikimate kinase
MEAGGVGLALQTRAAAFGSGQRRGGLQSPIGRLRVAEPAGAAVAVRARGSKPVVPLRAKKSSGGHENLHNSVDEALLLKRKSEEVLFYLNGRCIYLVGMMGSGKSTVGKIMSEVLGYSFFDSDKLVEQAVGMPSVAQIFKVHSEAFFRDNESSVLRDLSSMRRLVVATGGGAVIPTVNWYLEFTPFLSF

SEQ ID NO: 111 - protein, 307 aa, Zea mays
  misc_feature: Ceres CLONE ID no. 486613
  misc_feature (1)..(307): Functional Homolog of  Ceres CLONE ID no. 105319 at SEQ ID NO. 106 with e-value of 1.09E-63 and BLAST sequence identity of 63.0
  misc_feature (104)..(280): Pfam Name: SKI Pfam Description: Shikimate kinase
MEAGGIGLALQARAAGFGSGSGRRRGGLQAPTGSLRVADPAGPAVAVRARGSKPVAPLRLRAKKSSGGHENSHNSVDEALLLKRKSEEVLFYLNGRCIYLVGMMGSGKSTVGKIMSEVLGYSFFDSDKLVEQAVGMPSVAQIFKVHSEAFFRDNESSVLRDLSSMRRLVVATGGGAVIRPINWRYMKKGLSVWLDVPLDALARRIAKVGTASRPLLDQPSGDPYAMAFSKLSMLAQQRGDAYANADVRVSLEEIACKQGHDDVSKLTPTDIAIESLHKIESFVIEHTADSSASDAQTESQIQRIQTL

SEQ ID NO: 112 - protein, 295 aa, Triticum aestivum
  misc_feature: Ceres CLONE ID no. 749796
  misc_feature (1)..(295): Functional Homolog of  Ceres CLONE ID no. 105319 at SEQ ID NO. 106 with e-value of 7.79E-67 and BLAST sequence identity of 62.5
  misc_feature (108)..(284): Pfam Name: SKI Pfam Description: Shikimate kinase
MDAGVGLRPRPRAAWAGRRKPQGFPPATVPAVRLDQNPARRPLVLRSDAGSRSTDPIRGASLKGLCCHKSAGTEKVHYSADEALVLKQKAEDVLPYLNDRCVYLVGMMGSGKTTVGKIIAEVLGYSFFDSDKLVEQSVGIPSVAEIFQVHSEAFFRDNESEVLRDLSSMHRLIVATGGGAVIRPINWSYMKKGLTIWLDVPLDALARRIAAVGTASRPLLHQESGDPYAKAYAKLTALFEQRMDSYANADARVSLENIALKQGHNDVNVLTPSTIAIEALLKMESFLTEKAMVRN

SEQ ID NO: 113 - protein, 308 aa, Oryza sativa subsp. japonica
  misc_feature: Public GI no. 56805577
  misc_feature (1)..(308): Functional Homolog of  Ceres CLONE ID no. 105319 at SEQ ID NO. 106 with e-value of 5.09E-66 and BLAST sequence identity of 62.1
  misc_feature (105)..(281): Pfam Name: SKI Pfam Description: Shikimate kinase
MEAGVGLALQSRAAGFGGSDRRRSALYGGEGRARIGSLRVAEPAVAKAAVWARGSKPVAPLRAKKSSGGHETLHNSVDEALLLKRKSEEVLFYLNGRCIYLVGMMGSGKSTVGKIMSEVLGYSFFDSDKLVEQAVGMPSVAQIFKVHSEAFFRDNESSVLRDLSSMKRLVVATGGGAVIRPVNWKYMKKGLSVWLDVPLDALARRIAKVGTASRPLLDQPSGDPYTMAFSKLSMLAEQRGDAYANADVRVSLEEIASKQGHDDVSKLTPTDIAIESFHKIENFVIEHTVDNPVGDSQADSRAQRIQTL

SEQ ID NO: 114 - protein, 189 aa, Zea mays
  misc_feature: Ceres CLONE ID no. 294723
  misc_feature (1)..(189): Functional Homolog of  Ceres CLONE ID no. 105319 at SEQ ID NO. 106 with e-value of 4.69E-56 and BLAST sequence identity of 61.2
  misc_feature (2)..(178): Pfam Name: SKI Pfam Description: Shikimate kinase
MMGSGKTTVGKILSEVLGYSFFDSDKLVEKAVGISSVAEIFQLHSETFFRDNESEVLTDLSSMHRLVVATGGGAVIRPINWSYMKKGLTVWLDVPLDALARRIAAVGTASRPLLHQESGDPYAKAYAKLTSLFEQRMDSYANADARVSLEHIALKQGHNDVTILTPSTIAIEALLKMESFLTEKTMVRN

SEQ ID NO: 115 - protein, 302 aa, Fagus sylvatica
  misc_feature: Public GI no. 76782196
  misc_feature (1)..(302): Functional Homolog of  Ceres CLONE ID no. 105319 at SEQ ID NO. 106 with e-value of 3.70E-79 and BLAST sequence identity of 61.0
  misc_feature (114)..(290): Pfam Name: SKI Pfam Description: Shikimate kinase
MDGKVANGLVVSPRIGSERFARRTCGSVRVSRRFREQDRLPVLVSAQLQDKTRNSNWHKTASLEVSCSYKNFPASVLESGGIHAPFDDALILKNKSQEIEPYLSGRCIYLVGMMGSGKTTVGKVLSQVLSYAFFDSDTLVEQDVDANSVAEIFNLYGEGFFRDKETEVLRKLSLMHRLVVSTGGGAVVRPINWKYMQKGISVWLDVPLEALARRIAAVGTGSRPLLHHDSGDAYTKTFMRLTSLMEERSEAYANANARVSLEDVAAKLGHRDVSNLTPTAIAIEALEQIEGFLKEENGDFAL

SEQ ID NO: 116 - protein, 189 aa, Zea mays
  misc_feature: Ceres CLONE ID no. 1374869
  misc_feature (1)..(189): Functional Homolog of  Ceres CLONE ID no. 105319 at SEQ ID NO. 106 with e-value of 4.69E-56 and BLAST sequence identity of 60.7
  misc_feature (2)..(178): Pfam Name: SKI Pfam Description: Shikimate kinase
MMGSGRTTVGKILSEVLGYSFFDSDKLVEKAVGISSVAEIFQLHSETFFRDNESEVLRDLSSMHRLVVATGGGAVIRPINWSYMKKGLTVWLDVPLDALARRIAAVGTASRPLLHQESGDPYAKAYAKLTSLFEQRMDSYANADARVSLEHIALKQGHNDVTILTPSTIAIEALLKMESFLTEKTMVRN

SEQ ID NO: 117 - protein, 307 aa, Oryza sativa subsp. japonica
  misc_feature: Public GI no. 56805579
  misc_feature (1)..(307): Functional Homolog of  Ceres CLONE ID no. 105319 at SEQ ID NO. 106 with e-value of 4.59E-65 and BLAST sequence identity of 60.6
  misc_feature (103)..(279): Pfam Name: SKI Pfam Description: Shikimate kinase
MEARAGLAMQSRAAVGVGAGPGVGRRGRAVIRVGKRPTAASLRVGGPAGPAAAKPLAPLYCLKASRGHDSLHNSVDEALLLKRKSEEVLFYLNGRCIYLVGMMGSGKSTVAKILAEVLGYSFFDSDKLVEQAVGMPSVAQIFKEHSEAFFRDNESSVLRDLSSMRRLVVATGGGAVIRPVNWKYMKKGLSVWLDVPLDALARRIAQVGTASRPLLDQPSSDPYTAAFSKLSMLAEQRGDAYANADARVSLEEIAAKQGHDDVSKLTPTDIAIEALLKIENFVTEHSTSSGPVGDLIVDSQNRRTKAL

SEQ ID NO: 118 - protein, 205 aa, Zea mays
  misc_feature: Ceres CLONE ID no. 276706
  misc_feature (1)..(205): Functional Homolog of  Ceres CLONE ID no. 105319 at SEQ ID NO. 106 with e-value of 2.60E-55 and BLAST sequence identity of 59.3
  misc_feature (2)..(178): Pfam Name: SKI Pfam Description: Shikimate kinase
MMGSGKSTVGKIMSEVLGYSFFDSDKLVEQAVGMPSVAQIFKVHSEAFFRDNESSVLRDLSSMRRLVVATGGGAVIRPVNWKYMKKGLSVWLDVPLDALARRIAKVGTASRPLLDQPSGDPYTMAFSKLSMLAEQRGDAYANADVRVSLEEIASKQGHGDVSKLMPTDIAIESLHKIESFVIEHAADNPASDSQAESQIQRIQTL

SEQ ID NO: 119 - protein, 305 aa, Triticum aestivum
  misc_feature: Ceres CLONE ID no. 840744
  misc_feature (1)..(305): Functional Homolog of  Ceres CLONE ID no. 105319 at SEQ ID NO. 106 with e-value of 2.99E-61 and BLAST sequence identity of 59.3
  misc_feature (105)..(281): Pfam Name: SKI Pfam Description: Shikimate kinase
MEAGVGLALQSRAAGFGSGRRRSSMYGGESGARVVSLRVSDLVGSPAAVRARGAKPVVPLRAKKSSGGGHENLHNSVDDALLLKRKSEEVLFQLNGRCIYLVGMMGSGKSTVGKILAEVLGYSFFDSDKLVEQAVGMPSVAQIFKVHSEAFFRDNESSVLRDLSSMRRLVVATGGGAVIRPVNWKNMKKGLSVWLDVPLEALARRIAKVGTASRPLLDQPSGDPYTMAFSKLSTLAEQRGDAYANADVRVSLEEIASKLGHDDVSKLTPIDIALESLHKIESFVVEDTAVADSQTESQAQRIHTL

SEQ ID NO: 120 - DNA, 936 bp, Populus balsamifera subsp. trichocarpa
  misc_feature: Ceres ANNOT ID no. 1456544
  misc_feature: Encodes the peptide given in SEQ ID NO. 121
atggaggcaaatcttgcacaaagaatgcaaatttcgacaacatggattgattcatacaagtttccaagaaaaccaactagttccctgcggttttcggggagatttaaggaacagaagagactccaagtgtttgtttctgctcagtttcggcctgtaagagatgaaaatcgacatagacaggcttcttttgaggtttcttgttcttgtaacaattctcaagtttcaacgttggaatctgaaagtctccaggatttgtttggcgaggaagctttgattttgaagaataagtcacaagagattgagccatatttaaatggacgctgtatatatcttgttgggatgatgggctctggaaaaactacagtgggaaagattctctcacgatcaattcgttattcattctgtgactgtgacaaactggtggagcaggatgttggtgtgccttctgtagctgaaatatttgaaatatatggagaggatttcttcagagataaagagactgaggcattagaaaagctatcaatagaacaccggtttgttgtttccactggtggcggtgctgtgatacgggatgaaaactggatatacatgaggaaggggattagtgtctggttagatgtgcctttggaagaattggcacagaggatcgcggctgtaggaaccaagtctcgcccccttttggataatgaatcaggagatgcatacaacactgcattcagacgcctttctactctgtttgagaagagacataaagcttatgaaaatgccaaggcgagggtttctctggaaaatattgcagccaaactaggatataaagatgtatccagtatcacacctgctatgattgcgattgagcagaacatggcttgtgtgatgcatgatgtggaaggtttccatttattaccagcaggatttgggatgcgaaagatgtgttag

SEQ ID NO: 121 - protein, 303 aa, Populus balsamifera subsp. trichocarpa
  misc_feature: Ceres ANNOT ID no. 1456544
  misc_feature (1)..(303): Functional Homolog of  Ceres CLONE ID no. 105319 at SEQ ID NO. 106 with e-value of 4.50E-74 and BLAST sequence identity of 59.3
  misc_feature (107)..(283): Pfam Name: SKI Pfam Description: Shikimate kinase
MQISTTWIDSYKFPRKPTSSLRFSGRFKEQKRLQVFVSAQFRPVRDENRHRQASFEVSCSCNNSQVSTLESESLQDLFGEEALILKNKSQEIEPYLNGRCIYLVGMMGSGKTTVGKILSRSIRYSFCDCDKLVEQDVGVPSVAEIFEIYGEDFFRDKETEALEKLSIEHRFVVSTGGGAVIRDENWIYMRKGISVWLDVPLEELAQRIAAVGTKSRPLLDNESGDAYNTAFRRLSTLFEKRHKAYENAKARVSLENIAAKLGYKDVSSITPAMIAIEQNMACVMHDVEGFHLLPAGFGMRKMC

SEQ ID NO: 122 - DNA, 655 bp, Arabidopsis thaliana
  misc_feature: Ceres CLONE ID no. 29658
  misc_feature: Predicted sequence
  misc_feature: Encodes the peptide given in SEQ ID NO. 123
attcatctccaaactttcaaaaaaaaacctaaaacaaaaaaaatctctttccttcttctttctccatcaatggcgtcaacaaaacccaccgatcaaatcaaacaactcaaagatatcttcgctcgcttcgacatggacaaggacggaagcttaacgcagctagaactcgccgctcttctgcgttctctcggaatcaaacctcgcggcgatcaaatctctcttctgtaaaaccaaatcgaccgtaacggtaacggatccgtagagttcgacgagctcgtcgtggcgatattgccggatataaacgaagaggtgttgataaatcaagaacagttgatggaggttttccgttcgtttgatcgtgacggtaacggttcaataacggcggcggaacttgctgggtcaatggctaaaatgggacatccgttgacttaccgtgaattaacggaaatgatgacggaagctgattcaaacggtgacggtgttattagttttaatgagttttctcatattatggctaaatcggctgctgattttcttggattaaccgcttcttgatctgttttgttttaattactctctttttttcttctcctgtcaatgcaacttgtgcaattaacaatgtgctaatctttcgtttggtgtgacgtaaaaattt

SEQ ID NO: 123 - protein, 161 aa, Arabidopsis thaliana
  misc_feature: Ceres CLONE ID no. 29658
  misc_feature: Ceres ANNOT ID no. 842118
  misc_feature: Phenotype: ROSETTE LEAVES Useful for making ornamental plants with modified leaves
  misc_feature (48)..(76): Pfam Name: efhand Pfam Description: EF hand
  misc_feature: Full Length Peptide Sequence for Ceres CLONE ID no. 29658
MASTKPTDQIKQLKDIFARFDMDKDGSLTQLELAALLRSLGIKPRSDQISLLLNQIDRNGNGSVEFDELVVAILPDINEEVLINQEQLMEVFRSFDRDGNGSITAAELAGSMAKMGHPLTYRELTEMMTEADSNGDGVISFNEFSHIMAKSAADFLGLTAS

SEQ ID NO: 124 - DNA, 483 bp, Populus balsamifera subsp. trichocarpa
  misc_feature: Ceres ANNOT ID no. 1464081
  misc_feature: Encodes the peptide sequence given in SEQ ID NO. 125
atggcaacccttcagaccgatcagctcaagcagctcaaggacatcttcattcgcttcgacatggattccgatggcagcctcacgcagctggagctcgctgcgcttctacgttctcttggcctcaaacctacaggtgatcaacttcatgttctgttatcaaacatggatgctaatggaaatggttatgttgagtttgatgagctggtcagtgctatattgcctgatatgaatgaagaagtattgatcaaccaggagcagttgttggaggtttttcgatcatttgacagggatggcaatggattcattactgctgctgagcttgcaggatcaatggctaaaatgggacaccctttgacgtatcgtgagctatcagatatgatgagagaggctgacaccaatggagatggtgttttgagttttaatgagtttgcaaacgtcatggcaaaatctgctgctgattttcttggcatcaaagttccatag

SEQ ID NO: 125 - protein, 140 aa, Populus balsamifera subsp. trichocarpa
  misc_feature: Ceres ANNOT ID no. 1464081
  misc_feature (1)..(140): Functional Homolog of  Ceres CLONE ID no. 29658 at SEQ ID NO. 123 with e-value of 4.20E-55 and BLAST sequence identity of 81.7
  misc_feature (27)..(55): Pfam Name: efhand Pfam Description: EF hand
MDSDGSLTQLELAALLRSLGLKPTGDQLHVLLSNMDANGNGYVEFDELVSAILPDMNEEVLINQEQLLEVFRSFDRDGNGFITAAELAGSMAKMGHPLTYRELSDMMREADTNGDGVLSFNEFANVMAKSAADFLGIKVP

SEQ ID NO: 126 - protein, 158 aa, Glycine max
  misc_feature: Ceres CLONE ID no. 651548
  misc_feature (1)..(158): Functional Homolog of  Ceres CLONE ID no. 29658 at SEQ ID NO. 123 with e-value of 2.80E-58 and BLAST sequence identity of 78.9
  misc_feature (120)..(148): Pfam Name: efhand Pfam Description: EF hand
MLETDQIKQLNDIFKRFDMDQDGSLTHLELAALLRSLGIKPTGDEIYALLSNMDENGNGYIEFDELVHAIMPDLTESVLINQEQLLEVFRSFDRDGNGYITASELAGSMAKMGQPLTYRELASMMAEADSNGDGVISFNEFAALMAKSAAEFLGVKVA

SEQ ID NO: 127 - protein, 173 aa, Oryza sativa subsp. japonica
  misc_feature: Public GI no. 50932815
  misc_feature (1)..(173): Functional Homolog of  Ceres CLONE ID no. 29658 at SEQ ID NO. 123 with e-value of 4.80E-47 and BLAST sequence identity of 65.3
  misc_feature (61)..(89): Pfam Name: efhand Pfam Description: EF hand
MTTMAARRSEAAPAPQQLRGSQLKQLRELFRRFDMNGDGSLTQLELAALLRSLGLRPTGDEVHALLAGMDANGNGSVEFDELAAAIAPVLTTQTHLVDQAQLLEVFRAFDRDGNGFISAAELARSMARLGQPLTFEELTRMMRDADTDGDGVISFKEFAAVMAKSALDFLGVA

SEQ ID NO: 128 - protein, 172 aa, Zea mays
  misc_feature: Ceres CLONE ID no. 287120
  misc_feature (1)..(172): Functional Homolog of  Ceres CLONE ID no. 29658 at SEQ ID NO. 123 with e-value of 1.49E-45 and BLAST sequence identity of 64.0
  misc_feature (60)..(88): Pfam Name: efhand Pfam Description: EF hand
MTRSAPPASPPAPKPVLRGSQLEQLREIFRRFDMDGDGSLTQLELGALLRSLGLRPTGEEARALLAAMDSNGNGAVEFGELAAAIAPLLTTQTHLVDQAQLLEVFRAFDRDGNGYISAAELARSMARIGQPLTFEELTRMMRDADADGDGVISFNEFAAVMAKSALDFLGVA

SEQ ID NO: 129 - protein, 177 aa, Triticum aestivum
  misc_feature: Ceres CLONE ID no. 759217
  misc_feature (1)..(177): Functional Homolog of  Ceres CLONE ID no. 29658 at SEQ ID NO. 123 with e-value of 1.29E-44 and BLAST sequence identity of 63.3
  misc_feature (62)..(90): Pfam Name: efhand Pfam Description: EF hand
MTKPSPSPSPAPAKGAGSLRGSQLKQLRSLFDRFDMDGDGSLTQLELAALLRSLGLRPTGDESRALLLAIDADGSGTVEFDELARAIAPVLTAHAPRLVDQAQLLEVFRAFDRDGNGYISAAELARSMAKLGQPLTFEELRTMMRDADADGDGVISFGEFAAVMARSALDFLGVPAA

SEQ ID NO: 130 - protein, 149 aa, Malus x domestica
  misc_feature: Public GI no. 505152
  misc_feature (1)..(149): Functional Homolog of  Ceres CLONE ID no. 29658 at SEQ ID NO. 123 with e-value of 2.29E-24 and BLAST sequence identity of 43.3
  misc_feature (12)..(40): Pfam Name: efhand Pfam Description: EF hand
MADQLTDDQISEFKEAFSLFDKDGDGCITTKELGTVMRSLGQNPTEAELQDMINEVDADGNGTIDFPEPLNLMARKMKDTDSEEELKEAFRVFDKDQNGFISAAELRHVMTNLGEKLTDEEVDEMIREADVDGDGQINYEEFVKVMMAK

SEQ ID NO: 131 - DNA, 679 bp, Arabidopsis thaliana
  misc_feature: Ceres CLONE ID no. 2767
  misc_feature: Ceres Seed Line ID no. ME00774
  misc_feature: Encodes the peptide given in SEQ ID NO. 132
agaagctagaagaagaaaggagaagaagaaacaaagagagaagatgaagaatgttatgctgattattgacgagagcaacgcaagttatgatttactcatttgggcacttgaaaaccaaaaagataccattgagagctccaaagtttatatctttgcaaaacagccacaaaattcctttactcctcctaccgtactttcttcatcagtcggctttgctcaaattttctatccattttcacctaattcagaactcataagattggctcaagaaaagaatatgaaaattgctttgggtatattagagaaagccaagaagatatgtttaaatcatgggatcaaggcagagacatttactaatgttggagaccctaaagatctaatccgcaagataattcaagaacgaaatatcaatttaatagttacgagcgatcaacaaagtctcaaaaagtgtacacaaaatacagattgttctcttcttgtcgtgaagaaaagacttcgcaaagattaaagattaaggaagttacaaaattcaccaatatatataattttctatgtggttaattgagattgtgtaatgatttggggttgtagtttcaggtgttgatttggggttgtagtttgaacttataattgtgttatgtgtataaatatttgtgtttatatatatcaagttagtatg

SEQ ID NO: 132 - protein, 154 aa, Arabidopsis thaliana
  misc_feature: Ceres CLONE ID no. 2767
  misc_feature: Ceres Seed Line ID no. ME00774
  misc_feature (1)..(148): Pfam Name: Usp Pfam Description: Universal stress protein family
MKNVMLIIDESNASYDLLIWALENQKDTIESSKVYIFAKQPQNSFTPPTVLSSSVGFAQIFYPFSPNSELIRLAQEKNMKIALGILEKAKKICLNHGIKAETFTNVGDPKDLIRKIIQERNINLIVTSDQQSLKKCTQNTDCSLLVVKKRLRKD

SEQ ID NO: 133 - DNA, 597 bp, Populus balsamifera subsp. trichocarpa
  misc_feature: Ceres ANNOT ID no. 1486744
  misc_feature: Encodes the peptide given in SEQ ID NO. 134
atggagaaacaaatagaagggtctaagaagagggtgatggtgatcatagatgagagcgagtacagttatcattccttcatgtgggtagttgacaatctcaaagaatttatcactgagtcgccgcttgtcatccttgctgcacttcctgctcctaactgtaaatttttttatggggcacagtttggcaccgctgccctctgttgtccagtctctcccaccctagatttgatctgtgccattcaagaaaaaaacaagaagatcttattaggtatcttggagaaagctgtgaatatctgtgctagtcgaggggtgaaagcagaaacaattttagaagccggggagccttatgaactcacatgcaatgctgttcagaagaacaatattaatctcctcgtgattggtaacacatccattaatggaactctcaaaaggttaggaaatttctttgtaacttcaaaaatcatttcgacagctctcgaaagtcgcataaattgtatgaacctgattcaaaatgagttatttcaagaacttgaacatgctggcatggttgtcaaccctattaactcttgcaacaagctccactaccagaagcactga

SEQ ID NO: 134 - protein, 186 aa, Populus balsamifera subsp. trichocarpa
  misc_feature: Ceres ANNOT ID no. 1486744
  misc_feature (1)..(186): Functional Homolog of  Ceres CLONE ID no. 2767 at SEQ ID NO. 132 with e-value of 1.90E-18 and BLAST sequence identity of 43.4
MVIIDESEYSYHSFMWVVDNLKEFITESPLVILAALPAPNCKFFYGAQFGTAALCCPVSPTLDLICAIQEKNKKILLGILEKAVNICASRGVKAETILEAGEPYELTCNAVQKNNINLLVIGNTSINGTLKRLGNFFVTSKIISTALESRINCMNLIQNELFQELEHAGMVVNPINSCNKLHYQKH

SEQ ID NO: 135 - DNA, 540 bp, Populus balsamifera subsp. trichocarpa
  misc_feature: Ceres ANNOT ID no. 1463968
  misc_feature: Encodes the peptide given in SEQ ID NO. 136
atggagaaacaaatagaagggtctaatcagaaggtgatggtgatcatagatgagagtgagtgcagttatcatgcactcatgtgggtgcttgaaaatctcaaaggattcattactgactcaccgcttgtcatgtttgctgcactacctactcctaactgtaactttgcatatggggcacaacttggcaccactgcgttgtattgtacagtctcacccaccctaggtttgatttgttccatgcaagaaaaaagcaagaaaatcttattgggtgtcttggagaaagctgtggatatctgtgatagtcgaggggtgaaagcagagacaatcacagaagctggggagccttatgagctcataagcagtgctgttcaaaagaacaagattaatctactagtgatcggtgacacactcgttaatggaacccttaaaagtcacatgtctcttgatactggaatggttacagtgacgttaacctgttacccaaaacctcatcctactcaaaatatagattatcattcagatgggtaccaatacaaatga

SEQ ID NO: 136 - protein, 167 aa, Populus balsamifera subsp. trichocarpa
  misc_feature: Ceres ANNOT ID no. 1463968
  misc_feature (1)..(167): Functional Homolog of  Ceres CLONE ID no. 2767 at SEQ ID NO. 132 with e-value of 7.09E-19 and BLAST sequence identity of 43.0
MVIIDESECSYHALMWVLENLKGFITDSPLVMFAALPTPNCNFAYGAQLGTTALYCTVSPTLGLICSMQEKSKKILLGVLEKAVDICDSRGVKAETITEAGEPYELISSAVQKNKINLLVIGDTLVNGTLKSHMSLDTGMVTVTLTCYPKPHPTQNIDYHSDGYQYK

SEQ ID NO: 137 - DNA, 447 bp, Populus balsamifera subsp. trichocarpa
  misc_feature: Ceres ANNOT ID no. 1517263
  misc_feature: Encodes the peptide given in SEQ ID NO. 138
atggagaaacaaatagaagggtctaatcagaaggtgatggtgatcatagatgagagtgagtgcagttatcatgcactcatgtgggtgcttgaaaatctcaaaggattcattactgactcaccgcttgtcatgtttgctgcactacctactcctaactgtaactttgcatatggggcacaacttggcaccactgcgttgtattgtacagtctcacccaccctaggtttgatttgttccatgcaagaaaaaagcaagaaaatcttattgggtgtcttggagaaagctgtggatatctgtgatagtcgaggggtgaaagcagagacaatcacagaagctggggagccttatgagctcataagcagtgctgttcaaaagaacaagattaatctactagtgatcggtgacacactcgttaatggaacccttaaaagttcccgaccccactag

SEQ ID NO: 138 - protein, 136 aa, Populus balsamifera subsp. trichocarpa
  misc_feature (1)..(136): Ceres ANNOT ID no. 1517263
  misc_feature (1)..(136): Functional Homolog of  Ceres CLONE ID no. 2767 at SEQ ID NO. 132 with e-value of 7.09E-19 and BLAST sequence identity of 43.0
MVIIDESECSYHALMWVLENLKGFITDSPLVMFAALPTPNCNFAYGAQLGTTALYCTVSPTLGLICSMQEKSKKILLGVLEKAVDICDSRGVKAETITEAGEPYELISSAVQKNKINLLVIGDTLVNGTLKSSRPH

SEQ ID NO: 139 - protein, 162 aa, Triticum aestivum
  misc_feature (1)..(162): Ceres CLONE ID no. 684584
  misc_feature (1)..(162): Functional Homolog of  Ceres CLONE ID no. 2767 at SEQ ID NO. 132 with e-value of 2.29E-13 and BLAST sequence identity of 37.6
  misc_feature (11)..(159): Pfam Name: Usp Pfam Description: Universal stress protein family
MAAQAPPPPPPEQKMMVAIDESECSHYALEWALRNLAPRRLILFTVQPFSPLSYLPVGSPLGPSVASPELIRSVTEHQRQLAQALVDKAKAICAEHGVDAETVIEVGDPKETICEAAEKLNVDLLILGSHSRGPVQRFFLGSVSNYCSHHAKCPVLVVKKKE

SEQ ID NO: 140 - DNA, 468 bp, Populus balsamifera subsp. trichocarpa
  misc_feature (1)..(468): Ceres ANNOT ID no. 1463969
  misc_feature (1)..(468): Encodes the peptide given in SEQ ID NO. 141
atggcggagcacgtgacggaaaatggaggggtaccacttgagaggaaagtgatggttgccgttgatgatggtgagtatagccactatgctctcatgtgggtacttgacaatcttgaggaatctatcactaaatcacctctagttatcttcaccgcacagcctcctcccagcaataaccattcttttactgccgctgctctcagttctgctcgcatgtactgctcggtttcagccaatccggagtatacttacactatccaagaccagaataagaagatcgcgtttgctttgctggagaaagctaaagaaatttgtgctggtcgaggagttgatgctgagacattaacagaggtgggtgatcctcaaacagccatatgcgatgcagttcaaaggctcaatattagcctgcttgttttaggggagcgcggcattggcaaaatcaaaaggtgggatgatggcgcaagttaa

SEQ ID NO: 141 - protein, 138 aa, Populus balsamifera subsp. trichocarpa
  misc_feature: Ceres ANNOT ID no. 1463969
  misc_feature (1)..(138): Functional Homolog of  Ceres CLONE ID no. 2767 at SEQ ID NO. 132 with e-value of 1.19E-16 and BLAST sequence identity of 36.0
  misc_feature (1)..(136): Pfam Name: Usp Pfam Description: Universal stress protein family
MVAVDDGEYSHYALMWVLDNLEESITKSPLVIFTAQPPPSNNHSFTAAALSSARMYCSVSANPEYTYTIQDQNKKIAFALLEKAKEICAGRGVDAETLTEVGDPQTAICDAVQRLNISLLVLGERGIGKIKRWDDGAS

SEQ ID NO: 142 - protein, 148 aa, Glycine max
  misc_feature: Ceres CLONE ID no. 1059727
  misc_feature (1)..(148): Functional Homolog of  Ceres CLONE ID no. 2767 at SEQ ID NO. 132 with e-value of 1.90E-9 and BLAST sequence identity of 31.6
  misc_feature (1)..(145): Pfam Name: Usp Pfam Description: Universal stress protein family
MVAIDDSDCSKHALRWTLSYLKDSLADSDIILFTAQPQLDLSSVYASSYGAAPIELINSMQQNYKNAALNRIEEGTKICAESGVTPKKVMEFGNPKEAICDAVEKLGVDLLIVGSHGKGALERTFLGSVSNYCVNKAKCPVLVVRTKA

SEQ ID NO: 143 - protein, 165 aa, Zea mays
  misc_feature: Ceres CLONE ID no. 1272732
  misc_feature (1)..(165): Functional Homolog of  Ceres CLONE ID no. 2767 at SEQ ID NO. 132 with e-value of 2.29E-6 and BLAST sequence identity of 27.7
  misc_feature (12)..(161): Pfam Name: Usp Pfam Description: Universal stress protein family
METAAVAASSAGRRIMVAVDEGEESLHALNWCLANVVSPAGGDTLVLVHARRPRPVYAAMDSAGYMMTSDVLASVERHANAVSAAAVDKAKRVCADHPHVKVETTVESGDPRDVICDAANKMAADLLVMGSHGYGFIQRAFLGSVSNHCAQNCKCPVLIVKRPKE

SEQ ID NO: 144 - protein, 145 aa, Zea mays
  misc_feature: Ceres CLONE ID no. 283925
  misc_feature (1)..(145): Functional Homolog of  Ceres CLONE ID no. 2767 at SEQ ID NO. 132 with e-value of 2.29E-6 and BLAST sequence identity of 27.6
  misc_feature (1)..(141): Pfam Name: Usp Pfam Description: Universal stress protein family
MVAVDEGEESLHALNWCLANVVSPAGGDTLVLVHARRPRPVYAAMDSAGYMMTSDVLASVERHANAVSAAAVDKAKRVCADHPHVKVETMVESGDPRDVICDAANKMAVGSHGYGFIQRAFLGSVSNHCAQNCKCPVLIVKRPKE

SEQ ID NO: 145 - DNA, 901 bp, Arabidopsis thaliana
  misc_feature: Ceres CLONE ID no. 16403
  misc_feature: Ceres Seed Line ID no. ME01468
  misc_feature: Encodes the peptide given in SEQ ID NO. 146
gtcttgtgaattgtagccactatggcagtctcctcactctcaatccgctgtggtggtttctcaccaacaatctcccacaagacagaaattctctgtccaaatccatcactcaaagcttgttgtttactttcatccggtggtaaggccgactcctcggagagtacttaccaaaaaggcagcggaaacaattggaagagaaggcaagctcttgtgggagtaggaactttagtggcaacttcaattccagcaactttgcttcttgctgaagagataccaaaaagctactcgccttttgtggatcgagaagacgggtattcttactattacccatcagactggagggaatttgacttcagggcacatgattcagccttcaaagatagatacttgcaactgcagaatgtgcgggtcaggttcataccaacggagaaaaacgacatccatgaagtaggtcctatggaagaggtggtttatgatctagtgaagcataagtttgcagcaccaaaccaagtagctaccatctacgatatgaaagagagggtggaagatggaaagaactattacacgtttgagtatggactaagaactcctatctatgcaaccacttcctttgcaacagtggcagttggaaacaacagatactacactctcatagttggagcaaatgagagaaggtggaggaaagtgaaaaagcagcttcaagttgtggccgactctttgaagatccttcagatttgacaaacacaagaaacatcttactcctatatatctttctctctctgtggttacaaaactgtctgtagataacaatttgatattttcatattctctataactccaacgatggttttggcattgtgagttagattctgagttggttcagtaattcaatcaaacttgc

SEQ ID NO: 146 - protein, 238 aa, Arabidopsis thaliana
  misc_feature: Ceres CLONE ID no. 16403
  misc_feature: Ceres Seed Line ID no. ME01468
  misc_feature: Phenotype: Cold Germination Useful for making plants with increased tolerance to cold stress
  misc_feature: Phenotype: Cold Growth Useful for making plants with increased tolerance to cold stress
  misc_feature (54)..(236): Pfam Name: PsbP Pfam Description: PsbP
MAVSSLSIRCGGFSPTISHKTEILCPNPSLKACCLLSSGGKADSSESTYQKGSGNNWKRRQALVGVGTLVATSIPATLLLAEEIPKSYSPFVDREDGYSYYYPSDWREFDFRAHDSAFKDRYLQLQNVRVRFIPTEKNDIHEVGPMEEVVYDLVKHKFAAPNQVATIYDMKERVEDGKNYYTFEYGLRTPIYATTSFATVAVGNNRYYTLIVGANERRWRKVKKQLQVVADSLKILQI

SEQ ID NO: 147 - protein, 234 aa, Glycine max
  misc_feature: Ceres CLONE ID no. 611156
  misc_feature (1)..(234): Functional Homolog of  Ceres CLONE ID no. 16403 at SEQ ID NO. 146 with e-value of 7.29E-67 and BLAST sequence identity of 58.9
  misc_feature (63)..(232): Pfam Name: PsbP Pfam Description: PsbP
MVVSSCSLSWISPCLSHKLNLPHTNCLPRNIATSSSNTVFCELDTTPSGESHCRRRPLLLGIGALTANLQPTNLVFAQEKPDRYRAFVDYEDGYSYVYPIDWKEFDFRAHDSAFKDRYLQLQNVRVRFIPTEKKDIRDLGPMEEVIYDLVKHRYAAPNQRPTINDMQEKTIDGKHYYTFEYILTSPNYSSASFATIAIGNGRYYTLIVGANERRWKRFRDQLKVVADSFRLLDI

SEQ ID NO: 148 - DNA, 699 bp, Populus balsamifera subsp. trichocarpa
  misc_feature: Ceres ANNOT ID no. 1464944
  misc_feature: Encodes the peptide given in SEQ ID NO. 149
atggcaatatcttcactctcattgagttgggcttccactaccttatcccaaaagttaagtgtccctggttcaaatgaaatattgcctagagtagcagcattttctggcaataactctgtaacatgcacggcagaggcaaccttcaatgaagaaagcaattgcaagagacgtctgctactgctaggagttggagcactaacgacaagtttagtcccagcaaatttcctttttgctgaagagataccaaagaactacacatcttttgtggactttgaagatgggtattcatattattacccctcagactggattgattttgacttcaggggacatgattctgcatttaaggacagaacgaagcaattgcagaatgttagggtgagatttataccaaccgagaaaaaagacattcatgaattgggtccaatggaagagtatgacagtcacatgcagcaagaaattatgaacgtgaaactttcaaattttcttgaaaaccagaaaaccgtagagggaaaaaactactacaccttcgagtacgaacttacatctccaaactactcaagtgtttcatttgcaaccatagttattgccaatgggagattttacactctgatagttggcgcaaatgaaagacggtggagaagatatcgcagtcagctaaaagtggtagcagactctttcaaggtgcttgacatctaa

SEQ ID NO: 149 - protein, 232 aa, Populus balsamifera subsp. trichocarpa
  misc_feature: Ceres ANNOT ID no. 1464944
  misc_feature (1)..(232): Functional Homolog of  Ceres CLONE ID no. 16403 at SEQ ID NO. 146 with e-value of 4.39E-60 and BLAST sequence identity of 56.2
  misc_feature (53)..(230): Pfam Name: PsbP Pfam Description: PsbP
MAISSLSLSWASTTLSQKLSVPGSNEILPRVAAFSGNNSVTCTAEATFNEESNCKRRLLLLGVGALTTSLVPANFLFAEEIPKNYTSFVDFEDGYSYYYPSDWIDFDFRGHDSAFKDRTKQLQNVRVRFIPTEKKDIHELGPMEEYDSHMQQEIMNVKLSNFLENQKTVEGKNYYTFEYELTSPNYSSVSFATIVIANGRFYTLIVGANERRWRRYRSQLKVVADSFKVLDI

SEQ ID NO: 150 - protein, 178 aa, Oryza sativa subsp. japonica
  misc_feature: Public GI no. 31432520
  misc_feature (1)..(178): Functional Homolog of  Ceres CLONE ID no. 16403 at SEQ ID NO. 146 with e-value of 4.20E-32 and BLAST sequence identity of 39.8
  misc_feature (20)..(175): Pfam Name: PsbP Pfam Description: PsbP
MLLAAGAAVFLSWPNLAANAAEAKKGFLPVTDKKDGYSFLYPFGWQEVVVQGQDKVYKDVIEPLESVSVNTIPTSKQDIRELGPPDQVAEALIRKVLAAPTQKTKLIEAKENDVDGRTYYTFEFTAQAPNFTRHALGAIAIANGKFYTLTTGANERRWEKIKDRLHTVVDSFKIEARV

SEQ ID NO: 151 - protein, 257 aa, Oryza sativa subsp. japonica
  misc_feature: Public GI no. 50944591
  misc_feature (1)..(257): Functional Homolog of  Ceres CLONE ID no. 16403 at SEQ ID NO. 146 with e-value of 4.69E-33 and BLAST sequence identity of 39.5
  misc_feature (86)..(241): Pfam Name: PsbP Pfam Description: PsbP
MATHSTSAPAAPAFSAFPLAAAVRFPCASATSNTCAFSLAEHLTREGMFFDLQSIKREAEERSRRRMLLAAGAAMFLSWPNPAAYAAEAKKGFLPVTDKKDGYSFLYPFGWQEVVVQGQDKVYKDVIEPLESVSVNTIPTSKQDIRELGPPDQVAEALIRKVLAAPTQKTKLIEAKENDVDGRTYYTFEFTAQAPNFTRHALGAIAIANGKFYTLTTGANERRWEKIKDRLHTVVDSFKIEAREVRFNGKCREHGSY

SEQ ID NO: 152 - protein, 242 aa, Zea mays
  misc_feature: Ceres CLONE ID no. 1551032
  misc_feature (1)..(242): Functional Homolog of  Ceres CLONE ID no. 16403 at SEQ ID NO. 146 with e-value of 2.39E-32 and BLAST sequence identity of 39.2
  misc_feature (59)..(239): Pfam Name: PsbP Pfam Description: PsbP
MATAVPAACLRAPCSSPAAVARRLGAGGPSLRKRHCAVAPVAAACGPAPPRLLDNEEAVCSVRRRVLVAGAAAFLSRPNPAAFAAEAKKGFLPVVDKKAGYSFLYPFGWEEVAVQGQDKVYKDVIEPLESVSVNSIPTSKEDIRDLGPPDKVAEALIKKVLAPSTQKTKLIEAKENDVDGRAYYTFEFTAQAPNYTRHALGAIVIANGKFYTLTTGANERRWEKMKDRLHTVVDSFKIENRI

SEQ ID NO: 153 - DNA, 1172 bp, Arabidopsis thaliana
  misc_feature: Ceres CLONE ID no. 3964
  misc_feature: Ceres Seed Line ID no. ME00199
  misc_feature: Encodes the peptide given in SEQ ID NO. 154
aaagcatcaaataagtaaataaaaactcttttatgttcacctttttcactatcctctctttgtgtttcaaatcgtgggaacaaattatcacaatggaggcttctaaagaagctcatcaccttccaaactacatgaaagacgacaacgttagtcaagaaaccaagaacttgatcacttctctaccttcagacaaagatttcatgggttatggtctctacaactacaaaggttgttggtactatccaaacacactccaagccgttcttgacgtccaaaaacacttcaagccacgagatactgatataatcctcgcttctttgcccaaaggtggaaccacttggctcaaatccctaattttcgctgttgtacatagagaaaagtaccgcggaacccctcaaacacatcctttgctcttacaaaaccctcatgaccttgtcccatttcttgaggttgagttatacgctaatagccaaattccggatctcgcaaagtattcttctcctatgatcttttctacacacatgcacttacaagcattgcgtgaagccaccacaaaagcttgcaaaaccgtatatgtgtgtagaggtatcaaagatacgtttgtctccggctggcattatagaaacatgttgcatcgcaccaagatggatcaagccacttttgagctcatgtttgatgcttattgtagaggagttctcttatatggaccttattgggaacatgtattgagctattggaaagggagcttggaagcaaaggagaatgttcttttcatgaagtacgaagagataattgaggagcctcgtgttcaagtcaagagactcgccgagttcttggaatgtccattcaccaaggaagaagaagaaagtggatcggtggaggagatcttgaagttgtgtagtttacgaaatttaagcaatttggaggttaataagaatgggacaacgagaattggtgtagattctcaggtgttctttaggaaaggtgaagttggtgattggaagaatcatcttacgccacaaatggcgaaaacctttgatgagattattgactatagactaggagactccggtttgatatttcaataaggttgtgttgtgttttttttcttttgtcatccgaaaataaattaggactcaaacgagtcattcttgaaaaaaaaaaaaaaaaaa

SEQ ID NO: 154 - protein, 351 aa, Arabidopsis thaliana
  misc_feature: Ceres CLONE ID no. 3964
  misc_feature: Ceres Seed Line ID no. ME00199
  misc_feature: Phenotype: Dark Green Useful for increasing chlorophyll and photosynthetic capacity
  misc_feature: Phenotype: WHOLE PLANT Useful for making bigger plants
  misc_feature: Phenotype: Curled 3 Useful for making plants with altered leaf shape eg curled leaves
  misc_feature: Phenotype: Standing Rosette Shaped Useful for making plants with increased biomass and foliage
  misc_feature (88)..(347): Pfam Name: Sulfotransfer_1 Pfam Description: Sulfotransferase domain
MFTFFTILSLCFKSWEQIITMEASKEAHHLPNYMKDDNVSQETKNLITSLPSDKDFMGYGLYNYKGCWYYPNTLQAVLDVQKHFKPRDTDIILASLPKGGTTWLKSLIFAVVHREKYRGTPQTHPLLLQNPHDLVPFLEVELYANSQIPDLAKYSSPMIFSTHMHLQALREATTKACKTVYVCRGIKDTFVSGWHYRNMLHRTKMDQATFELMFDAYCRGVLLYGPYWEHVLSYWKGSLEAKENVLFMKYEEIIEEPRVQVKRLAEFLECPFTKEEEESGSVEEILKLCSLRNLSNLEVNKNGTTRIGVDSQVFFRKGEVGDWKNHLTPQMAKTFDEIIDYRLGDSGLIFQ

SEQ ID NO: 155 - protein, 337 aa, Oryza sativa subsp. japonica
  misc_feature: Public GI no. 77552973
  misc_feature (1)..(337): Functional Homolog of  Ceres CLONE ID no. 3964 at SEQ ID NO. 154 with e-value of 1.49E-61 and BLAST sequence identity of 48.6
  misc_feature (73)..(324): Pfam Name: Sulfotransfer_1 Pfam Description: Sulfotransferase domain
MAPSFRLSSAPESADEATAHKEIYDQLRRVAETFPSAPSLIGLPCSRHPDGWYTFTNGVVSSMVIKEHLTARATDIFLTTFPKSGTTWLKVLLYSTLHRGTDELVAHSPHQLVPFLESQVFVNDRIPDLSSLSSPRLFMTHIPSQSLPNSVATSGCKVVYLCRDPKDCFVSLWHFWNRFMPWDIDEAHRQFCDGVSQFGPFWEHILGYWRWHVEKPNQVLFLTYEELAADTLGQLRRLAEFVGCPFTTEEQKHGVDRNIVEACALENMSGLEVNRSGTITIVDSTVPNNTFFRRGVVGDWRNHLTPEMARRIDEITKSKFKGSGLLLHPQFLQVKRE

SEQ ID NO: 156 - DNA, 1119 bp, Populus balsamifera subsp. trichocarpa
  misc_feature: Ceres ANNOT ID no. 1448303
  misc_feature: Encodes the peptide given in SEQ ID NO. 157
atgcctgcctctactacaacttccatggttctcaaccatttcacaaagaatcaagcaaatgacaatggagaggatttagagagattaaccaatgagtgcaaggaattgctgctttcactcccaagagagaagggttggagaactgcatgcctctataaatacaaagggttttggtgccaaccaaaagaaatccaagcgataatctcttttcaaaaacactttgaaccaagagacactgatgttatcctagcatcaatacctaaatcaggaactacctggctcaaagccctatcttttgccatcttgaatcgcaagaaatttgcaatctctagtaatgaccaccctttgctcgtctctaatcctcacgatcttgcacctttctttgagtacaagctttatgcagacaagcaagttcctgacctctcgaaactccctgatcctagactttttgccacccacattccatttgcttcacttcaagactccatcaagaagtctaattgccggattatttatatctgtagaaacccttttgacacttttatttcctcatggactttcagcaacaagctgagatcagaaactgttcctccactgttactagaggaaaccttcaaaatgtattgcgaaggggttgtagggttcggtcccttctgggaccatatgttgggatactggaaggaaagcttggagagacaagacaaggtgttgttcttgaagtatgaggacatgaaagcagatgttacgttttacttgaagaagattgccaaatttcttggctgccctttttcaatggaagaagaaaaggaaggtgtagtggaaaagatagccagcctttgtagctttgagaagatgaagaatttagaagttaacaaatctggaaggtctattacgaacttcgaaaataagcacttgtttaggaaagctgaagtcggagattgggtgaattatctgtctccttcaatggtgaagcaattatctcaattaatagaggaaaagttgggtggatctggaggtgtccaagctgctgctgctgctgcttcttcttcttcttctgttataaagaagaaattcgagctacagagatatggagagaataagaatacaaatgtcaattga

SEQ ID NO: 157 - protein, 364 aa, Populus balsamifera subsp. trichocarpa
  misc_feature: Ceres ANNOT ID no. 1448303
  misc_feature (1)..(364): Functional Homolog of  Ceres CLONE ID no. 3964 at SEQ ID NO. 154 with e-value of 2.89E-72 and BLAST sequence identity of 47.4
  misc_feature (70)..(330): Pfam Name: Sulfotransfer_1 Pfam Description: Sulfotransferase domain
MVLNHFTKNQANDNGEDLERLTNECKELLLSLPREKGWRTACLYKYKGFWCQPKEIQAIISFQKHFEPRDTDVILASIPKSGTTWLKALSFAILNRKKFAISSNDHPLLVSNPHDLAPFFEYKLYADKQVPDLSKLPDPRLFATHIPFASLQDSIKKSNCRIIYICRNPFDTFISSWTFSNKLRSETVPPLLLEETFKMYCEGVVGFGPFWDHMLGYWKESLERQDKVLFLKYEDMKADVTFYLKKIAKFLGCPFSMEEEKEGVVEKIASLCSFEKMKNLEVNKSGRSITNFENKHLFRKAEVGDWVNYLSPSMVKQLSQLIEEKLGGSGGVQAAAAAASSSSSVIKKKFELQRYGENKNTNVN

SEQ ID NO: 158 - DNA, 1233 bp, Populus balsamifera subsp. trichocarpa
  misc_feature: Ceres ANNOT ID no. 1501305
  misc_feature: Encodes the peptide given in SEQ ID NO. 159
atgcctgcctctactacaacttccatggttctcaaccatttcacaaagaatcaagcaaatgacaatggagaggatttagagagattaaccaatgagtgcaaggaattgctgctttcactcccaagagagaagggttggagaactgcatgcctctataaatacaaagggttttggtgccaaccaaaagaaatccaagcgataatctcttttcaaaaacactttgaaccaagagacactgatgttatcctagcatcaatacctaaatcaggaactacctggctcaaagccctatcttttgccatcttgaatcgcaagaaatttgcaatctctagtaatgaccaccctttgctcgtctctaatcctcacgatcttgcacctttctttgagtacaagctttatgcagacaagcaagttcctgacctctcgaaactccctgatcctagactttttgccacccacattccatttgcttcacttcaagactccatcaagaagtctaattgccggattatttatatctgtagaaacccttttgacacttttatttcctcatggactttcagcaacaagctgagatcagaaactgttcctccactgttactagaggaaaccttcaaaatgtattgcgaaggggttgtagggttcggtcccttctgggaccatatgttgggatactggaaggaaagcttggagagacaagacaaggtgttgttcttgaagtatgaggacatgaaagcagatgttacgttttacttgaagaagattgccaaatttcttggctgccctttttcaatggaagaagaaaaggaaggtgtagtggaaaagatagccagcctttgtagctttgagaagatgaagaatttagaagttaacaaatctggaaggtctattacgaacttcgaaaataagcacttgtttaggaaagctgaagtcggagattgggtgaattatctgtctccttcaatggtgaagcaattatctcaattaatagaggaaaagttgggtggatctggtattgaattcaaagtgtttccttatactagcactactccgtctacatctccaaggcttttcgctgctcacattccctattcatcattgcccgaatccatcaagaagtctaattgtcgtgaagtttacatttatcgtaacccttttaacgtggtggcatcctggtttcatttttccaatgttgaaggtgaaccagagaagctggatgaggagtatttttga

SEQ ID NO: 159 - protein, 410 aa, Populus balsamifera subsp. trichocarpa
  misc_feature: Ceres ANNOT ID no. 1501305
  misc_feature (1)..(410): Functional Homolog of  Ceres CLONE ID no. 3964 at SEQ ID NO. 154 with e-value of 6.70E-73 and BLAST sequence identity of 47.0
  misc_feature (353)..(397): Pfam Name: Sulfotransfer_1 Pfam Description: Sulfotransferase domain
MPASTTTSMVLNHFTKNQANDNGEDLERLTNECKELLLSLPREKGWRTACLYKYKGFWCQPKEIQAIISFQKHFEPRDTDVILASIPKSGTTWLKALSFAILNRKKFAISSNDHPLLVSNPHDLAPFFEYKLYADKQVPDLSKLPDPRLFATHIPFASLQDSIKKSNCRIIYICRNPFDTFISSWTFSNKLRSETVPPLLLEETFKMYCEGVVGFGPFWDHMLGYWKESLERQDKVLFLKYEDMKADVTFYLKKIAKFLGCPFSMEEEKEGVVEKIASLCSFEKMKNLEVNKSGRSITNFENKHLFRKAEVGDWVNYLSPSMVKQLSQLIEEKLGGSGIEFKVFPYTSTTPSTSPRLFAAHIPYSSLPESIKKSNCREVYIYRNPFNVVASWFHFSNVEGEPEKLDEEYF

SEQ ID NO: 160 - protein, 312 aa, Flaveria chloraefolia
  misc_feature: Public GI no. 68067679
  misc_feature (1)..(312): Functional Homolog of  Ceres CLONE ID no. 3964 at SEQ ID NO. 154 with e-value of 6.40E-61 and BLAST sequence identity of 46.6
  misc_feature (49)..(308): Pfam Name: Sulfotransfer_1 Pfam Description: Sulfotransferase domain
MEDIIKTLPQHTCSFLKHRFTLYKYKDAWNHQEFLEGRILSEQKFKAHPNDVFLASYPKSGTTWLKALAFAIITREKFDDSTSPLLTTMPHDCIPLLEKDLEKIQENQRNSLYTPISTHFHYKSLPESARTSNCKIVYIYRNMKDVIVSYYHFLRQIVKLSVEEAPFEEAFDEFCQGISSCGPYWEHIKGYWKASLEKPEIFLFLKYEDMKKDPVPSVKKLADFIGHPFTPKEEEAGVIEDIVKLCSFEKLSSLEVNKSGMHRPEEAHSIENRLYFRKGKDGDWKNYFTDEMTQKIDKLIDEKLGATGLVLK

SEQ ID NO: 161 - protein, 343 aa, Triticum aestivum
  misc_feature: Ceres CLONE ID no. 703785
  misc_feature (1)..(343): Functional Homolog of  Ceres CLONE ID no. 3964 at SEQ ID NO. 154 with e-value of 1.30E-60 and BLAST sequence identity of 46.2
  misc_feature (74)..(332): Pfam Name: Sulfotransfer_1 Pfam Description: Sulfotransferase domain
MASSPQSSSSAPKADDKAASHKEIYDQLLEVVSTYPTAPSGIGRPYTHHPDGWYAFTPAVVNAMVIKRHLKACDTDVFLSTFPKSGTTWLKALLFATLRRTADGPAIAALAAHSPHQLIPFLEVQVFSNGRIPDLSSLPAPRLLMTHIPSRSLPESVAASGCKVVYLCRDPKDCFVSLWHFWNRFAPSPWDLGEALQQFCDGVSLFGPFWEHVLGYWRWHVERPEQVLFLTYEELAADTLGQLKRLAAFLGRPFTSEEREARVDREIVEACAMESLAGLEVNRSGKTDMTESSVANNIFFRRGVVGDWKNHLTPEMARRIDEITDSKFRGSGLALTPATADQN

SEQ ID NO: 162 - protein, 325 aa, Brassica napus
  misc_feature: Public GI no. 3420008
  misc_feature (1)..(325): Functional Homolog of  Ceres CLONE ID no. 3964 at SEQ ID NO. 154 with e-value of 4.99E-61 and BLAST sequence identity of 45.8
  misc_feature (65)..(320): Pfam Name: Sulfotransfer_1 Pfam Description: Sulfotransferase domain
MSSSSSVPDYLRDEKLTQETRDLISSLPSEKGWLVSQIYQFQGRWHTEALLQGILTCQKHFKAKDSDIILVTNPKSGTTWLKSLVFALINRHKFPVSSGDHPLLVTNPHLLVPFMEGVYYESPDFDFSLLPFPRLMNTHISHLSLPESVKSSSCQIVYCCRNPKDMFVSLWHFGKKLAPQETADYPLEKAVEAFCQGKFIAGPFWDHVLEYWYASLENPNKVLFVTYEELKKQTEVEVKRIAEFIGCGFTAEEEVSEIVKLCSFESLSRLEVNRQGKLPNGIETNAFFRKGEIGGWRDTLSESLADAIDRTTEEKFGGSGLKFSC

SEQ ID NO: 163 - protein, 312 aa, Flaveria bidentis
  misc_feature: Public GI no. 1706738
  misc_feature (1)..(312): Functional Homolog of  Ceres CLONE ID no. 3964 at SEQ ID NO. 154 with e-value of 2.70E-60 and BLAST sequence identity of 45.8
  misc_feature (49)..(308): Pfam Name: Sulfotransfer_1 Pfam Description: Sulfotransferase domain
MEDIIKTLPQHTCSFLKQRFTLYKYQDVWNHQEFLEGRMLSEQTFKAHPNDVFLASYPKSGTTWLKALAFAIITREKFDDSTSPLLTTMPHDCIPLLEKDLEKIQENQRNSLYTPISTHFHYKSLPESARTSNCKIVYIYRNMKDVIVSYYHFLRQIVKLSVEEAPFEEAVDEFCQGISSCGPYWEHILGYWKASLEKPEIFLFLKYEDMKKDPVPSVKKLADFIGHPFTPKEEEAGVIENIIKLCSFEKLSSLEVNKSGMHRPEEAHSIENRLYFRKGKDGDWKNYFTDEMIEKIDKLIDEKLGATGLVLK

SEQ ID NO: 164 - protein, 323 aa, Brassica napus
  misc_feature: Public GI no. 3420004
  misc_feature (1)..(323): Functional Homolog of  Ceres CLONE ID no. 3964 at SEQ ID NO. 154 with e-value of 1.30E-60 and BLAST sequence identity of 44.4
  misc_feature (64)..(318): Pfam Name: Sulfotransfer_1 Pfam Description: Sulfotransferase domain
MESSSVPVYLKDENLTQETRDLLSSLPSEKGWLVSQMYQFEGIWQTQALVQGIVNCQKHFEANDSDVILATLAKSGTTWLKALLFALIHRHKFPVSGKHPLLVTNPHSLVPYLEGDYCSSPEVNFAELPSPRLMQTHLTHHSLPVSIKSSSCKIIYCCRNPKDMFVSIWHFGRKLAPEKTAEYPIETAVAAFCKGKFIGGPFWDHVLEYWYESLKNPNKVLFVTYEELKKQTEVEVKRIAEFIGCGFTAEEEVSEIVKLCSFESLSSLEVNRQGKLPNGIESNAFFRKGETGGWRDTLSESLADVIDRTTEQKFGGSGLKFSS

SEQ ID NO: 165 - protein, 323 aa, Brassica napus
  misc_feature: Public GI no. 38230552
  misc_feature (1)..(323): Functional Homolog of  Ceres CLONE ID no. 3964 at SEQ ID NO. 154 with e-value of 2.20E-58 and BLAST sequence identity of 44.4
  misc_feature (63)..(318): Pfam Name: Sulfotransfer_1 Pfam Description: Sulfotransferase domain
MSSSSSSYLRDEDLTQETRDLISSLPSEKGWLVSQMYQFQGRWHTQALLQGLLQYQKHFEAKDSDIILVTNPKSGTTWLKALVFSLINRHKFPVSSGDHPLLVTNPHLLIPFLEGVYYESPNFDFTELPSPRLMNTHISLLSLPESVKSSSCKIVYCCRNPKDMFVSLWHFGKKLASQETADYPIEKAVEAFCQGKFIGGPFWDHVLEYWYASLENPNKVLFVTYEELKKQTGDTIKRIAEFLGCGFIEEEEVGGIVKLCSFESLSSLEANREGKLPNGVETKAFFRKGEVGGWRDTLSESLAEEIDRTMEEKFQGSGLKFSC

SEQ ID NO: 166 - protein, 324 aa, Brassica napus
  misc_feature: Public GI no. 3420006
  misc_feature (1)..(324): Functional Homolog of  Ceres CLONE ID no. 3964 at SEQ ID NO. 154 with e-value of 9.20E-53 and BLAST sequence identity of 44.1
  misc_feature (65)..(319): Pfam Name: Sulfotransfer_1 Pfam Description: Sulfotransferase domain
MSSSSSVPDYLRDENLTQKTKDLISSLPSEKGWLVCQMYQFQGRWHTQALLQGILTCQKHFEAKDSDIILVTNPKSGTTWLKALVFALINRHKFPVYSVIILSCYQSALLVPFLGRSLLRSPDFDFSQLSSPRLMNTHISHLSLPESVKSSSCKIVYCCRNPKDMFVSLWHFGKKLAPEETADYPIEKAVEAFCQGKFIGGPFWDHVLEYWYASLENPNKVLFVSYEEPKKKTGETIKRIAEFLGCGLVGEEEVRAIVKLCSFESLSSLEVNREGKLPSGMETRAFFRKGEVGGWRDTLTESLAEVIDRTIEEKFQGSGLKFSC

SEQ ID NO: 167 - protein, 290 aa, Oryza sativa subsp. japonica
  misc_feature: Public GI no. 77552976
  misc_feature (1)..(290): Functional Homolog of  Ceres CLONE ID no. 3964 at SEQ ID NO. 154 with e-value of 3.59E-42 and BLAST sequence identity of 44.1
  misc_feature (182)..(290): Pfam Name: Sulfotransfer_1 Pfam Description: Sulfotransferase domain
MAPSFPLSFAPQSADEAAAHKEIYDQLRQTVETFPTAPNSSNSFTYSRHPDGWYTFPEGVVSAMVIKSHLTARTTDIFMVTFPKSGTTWLKTLLHSALHRGANDLAAHSPHQLVPFLETQVFIKDRIPDLSSLPAPRLLMTHIPSQSLPDSVADSGCKVVYLCRDPNRKFRPWDINEAHRHFCDGVSLFGPYWEHVLGYWRWHTKRPSQVLFLTYEELTTDTLGQLRHLAEFVGCPFMVEEQELGVDRKIVEACAMESLSRLEVNQSGTTDMVDKTYVNNIFFRRGVVGD

SEQ ID NO: 168 - protein, 345 aa, Zea mays
  misc_feature: Ceres CLONE ID no. 1064128
  misc_feature (1)..(345): Functional Homolog of  Ceres CLONE ID no. 3964 at SEQ ID NO. 154 with e-value of 1.19E-59 and BLAST sequence identity of 43.8
  misc_feature (74)..(332): Pfam Name: Sulfotransfer_1 Pfam Description: Sulfotransferase domain
MATVFPRDAGVSTPEADEAKKIYDEARRVVSTYETVPSPSGTLQDYCRHPSGWCITLPIMVSSMVAEQHFEARGTDVLLVTMPKSGTTWIKALLYAAAHRTDDTSSSILRQLASHNSHQLVPFLEAQVYTKDQIPDLSSLPAPRLFATHIPAESLPPSVVASGCKVVYLCRDPKDCFVSLWHFMNKFTPWDIDEAHGRFCEGVSLYGPFWEHVLSYWRWHVDRPGQVLFLTYEELSADPLGQLRRLAEFIGRPFTPGEQEAGVDREIAEACAMKSMVNQEVNQSRTTEIVEMPIPNGIFFRRGVVGDWTNYLTPEMAGRIDEITKSKFEGSGLMLPKTISEISKI

SEQ ID NO: 169 - protein, 279 aa, Oryza sativa subsp. japonica
  misc_feature: Public GI no. 77552975
  misc_feature (1)..(279): Functional Homolog of  Ceres CLONE ID no. 3964 at SEQ ID NO. 154 with e-value of 1.90E-54 and BLAST sequence identity of 43.0
  misc_feature (11)..(262): Pfam Name: Sulfotransfer_1 Pfam Description: Sulfotransferase domain
MVVKSHLTARATDIFLVTFPKSGTTWIKALPYSALHRRADELLAHSPHQLISFLESQVFVKDRIPDLSSLPEPWLLMTHIPSQSLPDSVAASGCKVVYLCRDPKDCFVSLWHFWNRFMPWNIDDAHRQFCNGVSLFGLYWEHVLSYWNWHVERPSEVLFLTYEELAADTLGHLRRLAEFVGRPFTTEEQDARVDRKIVEICAMESLSGLEVNRSGMTNFTKKDVPNNISFRRGVVGDWRNHLTPEMARRIDEITEVKFKGSGLLLHPPFLQVKRELNEL

SEQ ID NO: 170 - protein, 250 aa, Triticum monococcum
  misc_feature: Public GI no. 30349136
  misc_feature (1)..(250): Functional Homolog of  Ceres CLONE ID no. 3964 at SEQ ID NO. 154 with e-value of 6.29E-38 and BLAST sequence identity of 39.0
  misc_feature (55)..(248): Pfam Name: Sulfotransfer_1 Pfam Description: Sulfotransferase domain
MNKRLLDSRHCLANANCGLALPLVLFNVCCYEGLWVHYFHVAGAVALQLRLAPLQDDVIVASFPKSGTTWLNALTFATMARRTNPAAGAGHPLLRLNPHQCIPFLDKLFQSCTEAKLEALPSPRLMNTHMPIDMIMPGGGGCKVVYICREPKDMVISQWHFLRRLQPDLPLADLLESVCSGAMPYGPVWDHILGYWRASTARPDGVLFLRYEELLRNPAEKVRELARFVGLPFSDAEEEAGVVHDIVKLE

SEQ ID NO: 171 - DNA, 865 bp, Brassica napus
  misc_feature: Ceres CLONE ID no. 965405
  misc_feature: Ceres Seed Line ID no. ME09814
  misc_feature: Encodes the peptide given in SEQ ID NO. 172
agtcgtcgtcttctgtgtaagaaatatcttatcttaggtgtgcagaccgaagtctagagtatcttcaagcttcaacttcttagctatgtcggccgatgattcttcaaatgctacagatgttgacgggaagctcggctccgatttaaacgttaactctgacggtgaagatgcggcggataatgattcctcaaagacattgactattcctgctcccgccgtttgtcttgtccggttcgccggagatgcagctggtggtgccgtcatgggctctatctttggatatggttcaggattgttcaagaagaaaggctttaaaggatcatttgcagatgcaggacagtctgcaaagacttttgctgttttgtccggagtacacagtttggttgtttgccttctgaaacaactcagagggaaagatgatgccattaatgttggagttgctgggtgctgcaccggtcttgctcttagtttccctggtgctccacaggctcttctacagagttgcctcacttttggggctttctcttttatccttgagggactaaacaaaagacaaacagccttggctcactctgtctccttaagacaccaaaccggaaactttggagatcatcaacaacgtcctttacaactctccctggctctcccaatccatgaagaaatcaaaggattctcttctttctgcaagtccttaactaaacccaagaagatctaatttcgccatgattatccttttcttgttccttatgttctctctgtagattcttaatgattccctgcttttgctgtactttgtgagagaatattttatgaaagatcttttgatataaattttgcaccgtttgctctaaaaaaaaaaaaaaaa

SEQ ID NO: 172 - protein, 209 aa, Brassica napus
  misc_feature: Ceres CLONE ID no. 965405
  misc_feature: Ceres Seed Line ID no. ME09814
  misc_feature (39)..(157): Pfam Name: Tim17 Pfam Description: Tim17/Tim22/Tim23 family
MSADDSSNATDVDGKLGSDLNVNSDGEDAADNDSSKTLTIPAPAVCLVRFAGDAAGGAVMGSIFGYGSGLFKKKGFKGSFADAGQSAKTFAVLSGVHSLVVCLLKQLRGKDDAINVGVAGCCTGLALSFPGAPQALLQSCLTFGAFSFILEGLNKRQTALAHSVSLRHQTGNFGDHQQRPLQLSLALPIHEEIKGFSSFCKSLTKPKKI

SEQ ID NO: 173 - protein, 210 aa, Arabidopsis thaliana
  misc_feature: Ceres CLONE ID no. 5367
  misc_feature (1)..(210): Functional Homolog of  Ceres CLONE ID no. 965405 at SEQ ID NO. 172 with e-value of 6.89E-87 and BLAST sequence identity of 85.5
  misc_feature (40)..(158): Pfam Name: Tim17 Pfam Description: Tim17/Tim22/Tim23 family
MAANDSSNAIDIDGNLDSDSNLNTDGDEATDNDSSKALVTIPAPAVCLFRFAGDAAGGAVMGSIFGYGSGLFKKKGFKGSFADAGQSAKTFAVLSGVHSLVVCLLKQIRGKDDAINVGVAGCCTGLALSFPGAPQALLQSCLTFGAFSFILEGLNKRQTALAHSVSLRHQTGLFQDHHRALPLSLALPIPEEIKGAFSSFCKSLAKPRKF

SEQ ID NO: 174 - protein, 214 aa, Arabidopsis thaliana
  misc_feature: Public GI no. 79537394
  misc_feature (1)..(214): Functional Homolog of  Ceres CLONE ID no. 965405 at SEQ ID NO. 172 with e-value of 4.30E-78 and BLAST sequence identity of 79.6
  misc_feature (40)..(158): Pfam Name: Tim17 Pfam Description: Tim17/Tim22/Tim23 family
MAAENSSNAINVDTSLDSDSKPNRDANDMTDHDSSSKALVIPAPAVCLVRFAGDAASGAFMGSVFGYGSGLFKKKGFKGSFVDAGQSAKTFAVLSGVHSLVVCLLKQIRGKDDAINVGVAGCCTGLALSFPGAPQAMLQSCLTFGAFSFILEGLNKRQTALAHSVSFRQQTRSPQHDLPLLSLAIPIHDEIKGAFSSFCNSLTKPKKLKFPHAR

SEQ ID NO: 175 - protein, 212 aa, Arabidopsis thaliana
  misc_feature: Public GI no. 9758183
  misc_feature (1)..(212): Functional Homolog of  Ceres CLONE ID no. 965405 at SEQ ID NO. 172 with e-value of 7.30E-76 and BLAST sequence identity of 79.4
  misc_feature (40)..(156): Pfam Name: Tim17 Pfam Description: Tim17/Tim22/Tim23 family
MAAENSSNAINVDTSLDSDSKPNRDANDMTDHDSSSKALVIPAPAVCLVRFAGDAASGAFMGSVFGYGLFKKKGFKGSFVDAGQSAKTFAVLSGVHSLVVCLLKQIRGKDDAINVGVAGCCTGLALSFPGAPQAMLQSCLTFGAFSFILEGLNKRQTALAHSVSFRQQTRSPQHDLPLLSLAIPIHDEIKGAFSSFCNSLTKPKKLKFPHAR

SEQ ID NO: 176 - protein, 213 aa, Zea mays
  misc_feature: Ceres CLONE ID no. 1060894
  misc_feature (1)..(213): Functional Homolog of  Ceres CLONE ID no. 965405 at SEQ ID NO. 172 with e-value of 3.50E-76 and BLAST sequence identity of 77.5
  misc_feature (39)..(157): Pfam Name: Tim17 Pfam Description: Tim17/Tim22/Tim23 family
MAAENPSNGVDVDTSLASDSNDNRKASDLTNHDSSMALTVPSTAVCLGRFAGDAAGGAVMGSIFGYGSGLFKKKGFKGSFADAGQSAKNFAILSGVHSLVVCLLKKLRGKDDAINVGIAGCCTGLALSYPGAPQAMLQSCVTFGAFSFILEGLNKRQTALAHSVSSRHDQTRSLKDDLPLSLALPIHEEIKGAFSSFCKSLTKPKKLAFPSSR

SEQ ID NO: 177 - protein, 203 aa, Triticum aestivum
  misc_feature: Ceres CLONE ID no. 639280
  misc_feature (1)..(203): Functional Homolog of  Ceres CLONE ID no. 965405 at SEQ ID NO. 172 with e-value of 6.40E-45 and BLAST sequence identity of 68.0
  misc_feature (29)..(147): Pfam Name: Tim17 Pfam Description: Tim17/Tim22/Tim23 family
MAARSENESDGDVGTNPAEGGSSLSLPPLAAGPAVCVLRSAGDFAGGAFVGSIFGYGQGLLSKKGLKGSLGNAGSSAKSFAVLSGVQSLVLCLLRKLRGKDDIINSGIAGCCTGLALSFPGTPQALLQNCATFAAFSCIMEGLNKQQTAMAHTLTGNALTFAHDNGAGVLPPSLSPQSSMLPMLSPHAARPWSPSLRSTRQQH

SEQ ID NO: 178 - DNA, 645 bp, Populus balsamifera subsp. trichocarpa
  misc_feature: Ceres ANNOT ID no. 1494390
  misc_feature: Encodes the peptide given in SEQ ID NO. 179
atggcgacggcgaattctccaaacaccagcaacaactctgattccgatgtcgaagaccctaaccctaatccttcaagtaataataacaatgcatcaattattccttctgctgagtccagtaccccttccgtctgcctcatccgcttcgctggtgactccgctgcaggcgcctttatgggctccatcttcggctacggttcgggattgattaagaagaaaggcttcaaaggatcctttggggaagcaggatcttgtgccaagacttttgcagttctatctggagtacacagtttggttgtctgctttctgaagaggctgcgagggaaggatgatgtcatcaatgctggagtagctggatgttgtactggtcttgctctgagttttccaggtgcacctcaggcacttctgcagagttgccttacttttggagcattctcattcatcatcgaagggctgaacaagaagcaagcagcactggctcactctatttcttcaaggaataaatgtgactatcacagcaaaccttgtccgctagcactccctctttcagtccctcttccagatgaactaaaaggggccttctcctttttctgcaagtccttaaggaaacccaagagtgccaattttcccgccgccgccccctga

SEQ ID NO: 179 - protein, 214 aa, Populus balsamifera subsp. trichocarpa
  misc_feature: Ceres ANNOT ID no. 1494390
  misc_feature (1)..(214): Functional Homolog of  Ceres CLONE ID no. 965405 at SEQ ID NO. 172 with e-value of 8.10E-61 and BLAST sequence identity of 67.1
  misc_feature (38)..(156): Pfam Name: Tim17 Pfam Description: Tim17/Tim22/Tim23 family
MATANSPNTSNNSDSDVEDPNPNPSSNNNNASIIPSAESSTPSVCLIRFAGDSAAGAFMGSIFGYGSGLIKKKGFKGSFGEAGSCAKTFAVLSGVHSLVVCFLKRLRGKDDVINAGVAGCCTGLALSFPGAPQALLQSCLTFGAFSFIIEGLNKKQAALAHSISSRNKCDYHSKPCPLALPLSVPLPDELKGAFSFFCKSLRKPKSANFPAAAP

SEQ ID NO: 180 - protein, 136 aa, Artificial Sequence
  misc_feature: Ceres CDNA ID no. 23799376
  misc_feature: Ceres Clone ID no. 375578
  misc_feature: Ceres Seed Line ID no. ME02064
MGKRGKWFSAVKKVFSSSDPDGKEAKAQKADKSKSKRRWPFGKSKHSEPSISTVPGTAPAVAPLPSPPATQPHSLEIKDVNPVETDSEQNKHAYSVALASAVAAEAAAVAAQAAAEVVRLTAVTTAAPKMPVSSRE

SEQ ID NO: 181 - DNA, 1020 bp, Arabidopsis thaliana
  misc_feature: Ceres CLONE ID no.19199
  misc_feature: Encodes the peptide given in SEQ ID NO. 182
acccactagaaccgttgtaacctacgacccataataatgtaccatctccttatcattatcactacactctccttctcttcaattaacataaccttcgccgtcgatgaagctttcccttcaattcccactaccttcagcgtcgcaacgaaacaacactacgacgtaaaaccaatccaccatgaagtttatgacggagaaaggaagatatacgacatcagccaccagtacacgccggagttgccggtttgggagtcttcagaaggactagggaactttcttagacttgccgtgagtatgaagaatggatccgatgctaatatctcgaagatggaactatctgttcactctggaactcatgttgatgcaccaggccatttccatgaccattattatgagtctggttttgatactgattcacttgatcttcaaatccttaatggtcctgctttattggttgatgttccaagagataagaacatttcagctgaggttatgaaatcactacatattccaagagggatccgtcgtgttctctttaaaacattgaacactgataggaggcttatgtttaagaaagaatttgattcaagctttgtcgggtttatggtcgatggggcgaaatggttggttgaaaatacagacatcaaacttgttgggcttgattatctttcatttgctgcttatgatgaagcacctgcgacgcataggtttatacttgaacgacgggatataatccctgtcgaagcgctgaagctggatgacgtggaggtaggaatgtacacgcttcattgcttaccgttaagattggttggagcggaaggagcaccaacgagatgcattctcatcaagtgattcagttcatctttttctatctaagttgtatatgaattactgataataaacaataggctttttggcttcttgcttccaagatctcataaccatatcgaagatgttaacatatgggatgattttgttgtaaaagaagcgtctaatcttattatataaagtatggttttc

SEQ ID NO: 182 - protein, 271 aa, Arabidopsis thaliana
  misc_feature: Ceres CLONE ID no. 19199
  misc_feature (57)..(257): Pfam Name: Cyclase Pfam Description: Putative cyclase
  misc_feature (1)..(271): Functional Homolog of Ceres CLONE ID no. 8686 at SEQ ID NO. 80 with e-value of 2.60E-100 and BLAST sequence identity of 83.4
MYHLLIIITTLSFSSINITFAVDEAFPSIPTTFSVATKQHYDVKPIHHEVYDGERKIYDISHQYTPELPVWESSEGLGNFLRLAVSMKNGSDANISKMELSVHSGTHVDAPGHFHDHYYESGFDTDSLDLQILNGPALLVDVPRDKNISAEVMKSLHIPRGIRRVLFKTLNTDRRLMFKKEFDSSFVGFMVDGAKWLVENTDIKLVGLDYLSFAAYDEAPATHRFILERRDIIPVEALKLDDVEVGMYTLHCLPLRLVGAEGAPTRCILIK

SEQ ID NO: 183 - DNA, 1291 bp, Gossypium hirsutum
  misc_feature: Ceres CLONE ID no.1940431
  misc_feature: Encodes the peptide given in SEQ ID NO. 184
agggtatcacgatcccttaaaagcggcacagcaagccaatgagtggagcgcagattttaaacgcaaaaaaccaacttcacttcccatttcctagtcttccacgatgactcccctccacttcttcctcctcctcctcctttcgtcagctgctttaatctccgcggccgccgccaccgccaccaccgcatatccttccatcccgggcaccgattccacaactgattgtggcctatccggaggggacgagaatccagttcccatccgtcgcgaagtctacggtaacggcaagatattcgacatcagccataggtacaccgtcgacatgccgtcttgggaatccaaggacggcgtgggacagttcctatggttgcctaaaagcatgaagaacggttccctcgctaataattcggagatgaaactcccaactcacaccggcacccaccttgacgctcccggacacgtcatcgatcggtacttcgatgccggcttcgatgtcgataccctagatttggaagtacttaatggtcctgccctgttgatagatgttccaagggataaaaacattactgccgaggttatggagtctttgaaaataccaaagggagtacgtagagttcttttcagaacattaaatactgacaggcggctaatgtttaagaaagagtttgatacaagctacgttggatttatgaaggatggagcagagtggttggttaaacacactgacataaaacttattggaattgattacttatctgttgctgcctttgatgatttgattccatctcatatagttttcctagaagaccgggatatcattcttgtggaaggtttaaaactcgataacgttcaacctggaatatattcagtccattgcttaccattaagattgcttggtgctgaaggatcaccaacaagatgcattctcatcaaatgatgttgttgtccttgttactataaaagacttgagataagtgggtacgttttcaaggcaatgatgatgctaatggcacaccgtcatcttacaccgtcgtcttattaggcatgttgtttggaaagaggaaatgggcgggtgacattaagggtggtgtttgattggaacaaggcaaataacgggtttatgagttagaacttgacgctgttaggaatcctagaagggagcttcagtatagaaatttggttgcagtgaactacacttttcgtgtaatatatcattatgatatttcttttaagttcccttttatttcataaataataatacacttacgccatatttttggttggttggagt

SEQ ID NO: 184 - protein, 277 aa, Gossypium hirsutum
  misc_feature: Ceres CLONE ID no. 1940431
  misc_feature (63)..(263): Pfam Name: Cyclase Pfam Description: Putative cyclase
  misc_feature (1)..(277): Functional Homolog of Ceres CLONE ID no. 8686 at SEQ ID NO. 80 with e-value of 1.49E-86 and BLAST sequence identity of 72.1
MTPLHFFLLLLLSSAALISAAAATATTAYPSIPGTDSTTDCGLSGGDENPVPIRREVYGNGKIFDISHRYTVDMPSWESKDGVGQFLWLPKSMKNGSLANNSEMKLPTHTGTHLDAPGHVIDRYFDAGFDVDTLDLEVLNGPALLIDVPRDKNITAEVMESLKIPKGVRRVLFRTLNTDRRLMFKKEFDTSYVGFMKDGAEWLVKHTDIKLIGIDYLSVAAFDDLIPSHIVFLEDRDIILVEGLKLDNVQPGIYSVHCLPLRLLGAEGSPTRCILIK

SEQ ID NO: 185 - DNA, 1349 bp, Glycine max
  misc_feature: Ceres CLONE ID no.1646125
  misc_feature: Encodes the peptide given in SEQ ID NO. 186
aatatgtcgccgcctcaatttttcagaccaaaatgattttttaaaatttttttgtcattgttgtaaaaataacaaataataaataaaaaaattaaaaaataacattctgtcaagagatggatgtgtttcattcatctttgtgtttcattcatctttctcagtcaaccatgaactctcgatcactctttgccttcctcttcgcaatttgcgcgcactccgtcgccgttgccgacacctcctccgcgtatccttccatccccggcacggaaaccggtgagtgctccctccgcggcgtgggcgtgggcgacggtgttctggttcctccacggcgagaagtatacgaggaggggcgaatcttcgacatcactcacagatatgtccccgagatgccggtgtgggactcgacggaggggctcgggcaacacttcctgtggctcgataagagcatgaagaatggctcgctcgctaacagctctaacatgaagctcggtgttcacaccggcacccatgtcgacgcgcccggtcacttttacgacaattactacgacgctggcttcgacgttgactcactcgacctaacgctcctcaatggccttgcacttctggttgatgttccgcgggataaaaacattactgctgaggttatgaggtccctgaatatccctagaggtgtaagccgtgtgcttttcagaactttaaacactgacaggcgactcatgtttaagaaagaatttgacacaagctatgtgggattcaaggaggatggtgcaaaatggctggcagagaacactgacatcaaacttgtaggagttgattacttatctgttgctgcttatgatcactccattccatctcatcttgtttttctggaaagcaaggaaatcattcttgtggaaggcctaaagcttgatgatgtcccagcaggaatatattcattgaattgcttgcctcttaggttggttcactctgaggcatcaccaattcgatgtattctgatcagatgatccatgatggggtcaaacctggttttcaattgcacggatgaacctgccattagaagcaacgtagccccgaatacaattagtggtgtccataagaagcagtttgatgcaaattgcaagctaagctgatagtagtacgttgaaattactcgtattttacgtccttgggttgtaaactaccgagttattgtgattaaacttcagttgcggactaggggtccacctgtattaacttatgtttttaatatttacctaggcaagtacttgcgcaattctgaatacgcatgcttgtacgcctcaataattatatctatttctctatgaaaaataaaaaaaaaaaaaaaaaaa

SEQ ID NO: 186 - protein, 278 aa, Glycine max
  misc_feature: Ceres CLONE ID no. 1646125
  misc_feature (63)..(264): Pfam Name: Cyclase Pfam Description: Putative cyclase
  misc_feature (1)..(278): Functional Homolog of Ceres CLONE ID no. 8686 at SEQ ID NO. 80 with e-value of 5.39E-84 and BLAST sequence identity of 71.3
MNSRSLFAFLFAICAHSVAVADTSSAYPSIPGTETGECSLRGVGVGDGVLVPPRREVYEEGRIFDITHRYVPEMPVWDSTEGLGQHFLWLDKSMKNGSLANSSNMKLGVHTGTHVDAPGHFYDNYYDAGFDVDSLDLTLLNGLALLVDVPRDKNITAEVMRSLNIPRGVSRVLFRTLNTDRRLMFKKEFDTSYVGFKEDGAKWLAENTDIKLVGVDYLSVAAYDHSIPSHLVFLESKEIILVEGLKLDDVPAGIYSLNCLPLRLVHSEASPIRCILIR

SEQ ID NO: 187 - DNA, 953 bp, Panicum virgatum
  misc_feature: Ceres CLONE ID no.1759790
  misc_feature: Encodes the peptide given in SEQ ID NO. 188
acgtgtcaactgcacttccagaaaggcaaatccattccatggagctcgcgccgctgctcctgctccccccgctgctgctgctcccggcggcggccgtcgcctccggcggtgagccgccgctggcgcacccggcctatgcgcgcggcgccgaggaggcatgcggcgtggcggcgctgccagcgccggagcggcgcgaggagttcgacggcgggcggatcgtggacatcagccactactaccgcgcggacatgccggcgtgggagtcggcggagggctccggcgagttcctgcggctggcgcggtccatgcgcaacggctccgacatcgccaacttctcggagctccgcctcaccgcgcactccggcacccacgtcgacgcgccggggcacgtcttcgagcactactacgacaccggcttcgacgtcgacacgctcgacctcgccgtcctcaacgggccagcgctgttggttgacgttccccgagataagaacataacaggtgttcgacgtgtactcttccgaaccttaaatactgacagaaagcttatgtggaagaaagagtttgatactagttatgttggcttcatgaaggatggtgcacaatggctggtcgacaatactgacatcaaactagttggagttgattacttgtctgtgggtgcatttgacgaatgcattccagctcatctagtatttcttgaaaaaagggaggtaatccttgtggaagccttaaatctggagcatgctacccctggaatatatgccttgcattgcttgccactaagattgcgtggtgctgaaggttctcctgcaaaatgcatccttatcaagtgacacatggttacaaccatctagaaaacctttgtactatcttatggcacgtatgataatgaaataagaaaaggtcaacgcatatgacttcttctcttgcatcaaaaaaaaaaaaaaaaaaaa

SEQ ID NO: 188 - protein, 264 aa, Panicum virgatum
  misc_feature: Ceres CLONE ID no. 1759790
  misc_feature (60)..(250): Pfam Name: Cyclase Pfam Description: Putative cyclase
  misc_feature (1)..(264): Functional Homolog of Ceres CLONE ID no. 8686 at SEQ ID NO. 80 with e-value of 8.09E-74 and BLAST sequence identity of 68.2
MELAPLLLLPPLLLLPAAAVASGGEPPLAHPAYARGAEEACGVAALPAPERREEFDGGRIVDISHYYRADMPAWESAEGSGEFLRLARSMRNGSDIANFSELRLTAHSGTHVDAPGHVFEHYYDTGFDVDTLDLAVLNGPALLVDVPRDKNITGVRRVLFRTLNTDRKLMWKKEFDTSYVGFMKDGAQWLVDNTDIKLVGVDYLSVGAFDECIPAHLVFLEKREVILVEALNLEHATPGIYALHCLPLRLRGAEGSPAKCILIK

SEQ ID NO: 189 - DNA, 1029 bp, Triticum aestivum
  misc_feature: Ceres CLONE ID no.741003
  misc_feature: Encodes the peptide given in SEQ ID NO. 190
agcaccacctactagcccacacatatccgcgacgccgatgccccaaatggcgtctcctctcctcctcctccctctcgccgccgccaccgcaccgtgcgcccatccggcctacccgagccagccggcgtcgtgcgccgcggagcccgcgctggcgccggagcgccgggagacgcacggcgggggccgcatcctggacatcacccactactaccgggaggacatgccctcgtgggagtccagcgccggggtgggccagttcctgtggctgcccgcctccatgcgcaacggctccctcgccaacaactccgagatgcggatgcccacccacaccggcacccacgtcgacgcccccggccacgtcttccagcactacttcgacgctggcttcgacgtcgacaccctcgacctcgacgtcctcaacggtcctgcactgctggttgatgttccaagggatcaaaatattactgctaaaacgatggaatctttgcatattcctaaaggagttcaacgggtacttttcagaacattaaacactgacaggaacctaatgtggaagaaagagtttgacacaagctatgtaggttttatgaaagatggtgcccaatggttggtagacaacacggatattaagcttgtcggaatagactatttgtccgttgcagctttcgatgacctgatcccttcacatttagtttttctcgaaaaccgggatgtcattcttgtggagggcctcaaactggagaatgtcaaacctgggatatactcgttgcattgcctgccacttcggttgcgtggagcggaaggttcgccgatcagatgcatccttataaagtgaagacacttgtatcccgctgcgatttagttttataccgcaagcactcttataaactagactagagatgtgtacaaaaccccatctttgatagcggacgagtattgtaaatgtctccacaaacatggtggcactttgacgcttagtaaggagcgacaaacgactaggggtgcaaatgtgtaaaaaaaaaaaaaaaa

SEQ ID NO: 190 - protein, 265 aa, Triticum aestivum
  misc_feature: Ceres CLONE ID no. 741003
  misc_feature (51)..(251): Pfam Name: Cyclase Pfam Description: Putative cyclase
  misc_feature (1)..(265): Functional Homolog of Ceres CLONE ID no. 8686 at SEQ ID NO. 80 with e-value of 9.39E-80 and BLAST sequence identity of 67.2
MPQMASPLLLLPLAAATAPCAHPAYPSQPASCAAEPALAPERRETHGGGRILDITHYYREDMPSWESSAGVGQFLWLPASMRNGSLANNSEMRMPTHTGTHVDAPGHVFQHYFDAGFDVDTLDLDVLNGPALLVDVPRDQNITAKTMESLHIPKGVQRVLFRTLNTDRNLMWKKEFDTSYVGFMKDGAQWLVDNTDIKLVGIDYLSVAAFDDLIPSHLVFLENRDVILVEGLKLENVKPGIYSLHCLPLRLRGAEGSPIRCILIK

SEQ ID NO: 191 - protein, 269 aa, Oryza sativa subsp. japonica; identical to SEQ ID NO: 93
  misc_feature: Public GI ID no.. 35215089
  misc_feature (55)..(255): Pfam Name: Cyclase Pfam Description: Putative cyclase
  misc_feature (1)..(269): Functional Homolog of Ceres CLONE ID no. 8686 at SEQ ID NO. 80 with e-value of 1.90E-79 and BLAST sequence identity of 66.2

SEQ ID NO: 192 - protein, 270 aa, Oryza sativa subsp. japonica
  misc_feature: Public GI ID no.. 115475854
  misc_feature (56)..(256): Pfam Name: Cyclase Pfam Description: Putative cyclase
  misc_feature (1)..(270): Functional Homolog of Ceres CLONE ID no. 8686 at SEQ ID NO. 80 with e-value of 1.90E-79 and BLAST sequence identity of 66.2
MMAHLAPLFLLLLLLLLPLHAAATPSAHPAYPNEPPSCAAAVPVPERREAHGGGRILDITHYYREDMPSWESDGGVGQFLWLPASMRNGSRANNSEMRLPTHTGTHVDAPGHVFQHYFDAGFDVDSLDLEVLNGLALLVDVPRDDNITAKMMESLHIPKGIQRVLFRTLNTDRQLMWKKEFDTSYVGFMEDGAQWLVDNTDIKLVGIDYLSVAAFDDLIPSHLVLLKNRDIILVEGLKLENIMPGIYSLHCLPLRLRGAEGSPIRCILIK

SEQ ID NO: 193 - DNA, 909 bp, Populus balsamifera subsp. trichocarpa
  misc_feature: Ceres ANNOT ID no.1450986
  misc_feature: Encodes the peptide given in SEQ ID NO. 194
atggagggaaattttgcacaaagaatgcaaatttcgacaacatggattgatacaggcaatcttgcaagaaaaccaactggttttctacggttttcggggagattaaaggaacagaagagactccaagtgtttgtttctgctcagtttcgacctgtaagagatgaaaatcgacatagattggcttcttttgaggtttctcgctcttataacaattctcgagtttcgacgttggaatctgagagtctccaggatttgcttgacgatgaagctttgattttgaagaataagtcgcaggagattgagccctatttaaacggacgctgtatatatcttgttggaatgatgggctctggaaaaacaacagtgggaaagattctctcgcaagcaattcattattcattctgtgacagtgacacattggtggagaaggatgttggtgtgacttctgtagctgaaatatttcaaatatatggagaggatttcttcagagataaagagactgaggcattagaaaagctatcactagagcaccgatatgtcgtttctactggtggaggtgctgtgatacaggatgaaaactggacgtacatgaggaaggggattagtgtctggttagatgtgcctttggaagaattggcacagaggattgcggctgtaggaaccaagactcgcccccttttggatagagaaccaggagatgcatacaccaaggcgttcaggcgtctgtctgctctgtttgaacagagatataaagcttatgaaaatgctaatgcaagggtttctctggaaaatattgcagccaaattaggatataaagatgtatccaatatcacaccacctatgattgcgattgagaacatggcttgggtgatgcattacgcagcaggtttccgtctattaccagtgtaa

SEQ ID NO: 194 - protein, 302 aa, Populus balsamifera subsp. trichocarpa
  misc_feature: Ceres ANNOT ID no. 1450986
  misc_feature (115)..(291): Pfam Name: SKI Pfam Description: Shikimate kinase
  misc_feature (1)..(303): Functional Homolog of Ceres CDNA ID no. 23363195 at SEQ ID NO. 106 with e-value of 2.09E-73 and BLAST sequence identity of 55.9
MEGNFAQRMQISTTWIDTGNLARKPTGFLRFSGRLKEQKRLQVFVSAQFRPVRDENRHRLASFEVSRSYNNSRVSTLESESLQDLLDDEALILKNKSQEIEPYLNGRCIYLVGMMGSGKTTVGKILSQAIHYSFCDSDTLVEKDVGVTSVAEIFQIYGEDFFRDKETEALEKLSLEHRYVVSTGGGAVIQDENWTYMRKGISVWLDVPLEELAQRIAAVGTKTRPLLDREPGDAYTKAFRRLSALFEQRYKAYENANARVSLENIAAKLGYKDVSNITPPMIAIENMAWVMHYAAGFRLLPV

SEQ ID NO: 195 - DNA, 1392 bp, Gossypium hirsutum
  misc_feature: Ceres CLONE ID no.1973421
  misc_feature: Encodes the peptide given in SEQ ID NO. 196
ctctccgttatttggatctgatgttgattttatgttttaaagtgctttgttttcagtttttttttttggtgaagtagagcacataatttcagcattgcatgcaacttcaatctgaatttagggtttttattatgaaccgaacccgttttgcaaagatttaaaactatgggatctgcaagttatctgaaatagtcttcatttctcttggagtcagagagcaaagcccttcacaaaattcattttctctttattaattatccaaggggctgagaatggaggctggagttgcatgcaagttgaattatccgacatggattgagtcagaaaggtttgggaggaactcgactggtactttgcggttcagtcggatagcaaagcaagaacacaaggcccggctggttgtttcggcgcactttccggttctgacatcttctaatcggtttagatcggtctctttcgaggtttcctgctcttcctctaagaacttttcagcttcaacaattgaaactggtagcgttcatgcaccttatgatgaagctttagtgttaaagaataagtcactagaggttgagccatatttaaatgggcacagtatatatcttgttggattgatgggttctggaaaaactacagtgggaaaaattctgtctaacgtactcagttattcattttgtgacagtgacgtgttaatagagcaggaggtgaatggaatgtctgtagccgaagtatttaagcttcatggtgagagattcttcagaaagaaggagactgaggtattgcagaggctctcttcaaagaaacagcttgttgtttctactggcggaggtgcagttgtatgggatgtgaactgggattatatgcaaaagaagggggttgttgtctggttagatgtacctttggaagccttggcacagaggattgctgcagtaggtactcattctcgtccccttttgcattatgaacatggcgatccctatacaaaggctttaaaacggctgtcttaccttttggaactgaggggtaaaaattatgctaaagcaaatgcccgggtttcattgaaagaaattgcaggcaaactaggttatagagatgtatcagatcttactccaacagagattgcaatcgaggcattgcaacaaattgaagggtatctaaaggaggaaggtggcatggtcattgctggattatagttttgaaaaagctatagatatggtgattgaatttcgttttatttgtggcatagcatgtcaaaattgaccagtttttttttccatctctgcaccggtgtagtttgtttccacaactaagttgtgtaactcacaatgtattgtcactaaatatcatgaacatgatgcacttgtatatgtttgcctaattcatttttgttttagt

SEQ ID NO: 196 - protein, 305 aa, Gossypium hirsutum
  misc_feature: Ceres CLONE ID no. 1973421
  misc_feature (114)..(291): Pfam Name: SKI Pfam Description: Shikimate kinase
  misc_feature (1)..(306): Functional Homolog of Ceres CDNA ID no. 23363195 at SEQ ID NO. 106 with e-value of 2.90E-78 and BLAST sequence identity of 55.8
MEAGVACKLNYPTWIESERFGRNSTGTLRFSRIAKQEHKARLVVSAHFPVLTSSNRFRSVSFEVSCSSSKNFSASTIETGSVHAPYDEALVLKNKSLEVEPYLNGHSIYLVGLMGSGKTTVGKILSNVLSYSFCDSDVLIEQEVNGMSVAEVFKLHGERFFRKKETEVLQRLSSKKQLVVSTGGGAVVWDVNWDYMQKKGVVVWLDVPLEALAQRIAAVGTHSRPLLHYEHGDPYTKALKRLSYLLELRGKNYAKANARVSLKEIAGKLGYRDVSDLTPTEIAIEALQQIEGYLKEEGGMVIAGL

SEQ ID NO: 197 - protein, 287 aa, Oryza sativa subsp. japonica
  misc_feature: Public GI ID no.38344899
  misc_feature (100)..(276): Pfam Name: SKI Pfam Description: Shikimate kinase
  misc_feature (1)..(287): Functional Homolog of Ceres CDNA ID no. 23363195 at SEQ ID NO. 106 with e-value of 3.39E-66 and BLAST sequence identity of 55.5
MDAGVGLRAKPGAWAGLGNPRRSSTARVPVRFAVEKFAQPLVLGSDRRSCGAKLKVSCSRKPAGIDKTYYSADEALVLKQKAEDVVPYLNDRCIYLVGMMGSGKTTVGKILAEVLGYSFFDSDKLVEKAVGISSVAEIFQLHSEAFFRDNESEVLRDLSSMHRLVVATGGGAVIRPINWSYMKKGSTIWLDVPLDALARRIAAVGTASRPLLHQESGDPYAKAYAKLTALFEQRMDSYANADARVSLEHIAVKQGHSNVTTLTPSAIAIEALLKMESFLTEKAMIRN

SEQ ID NO: 198 - protein, 300 aa, Lycopersicon esculentum
  misc_feature: Public GI ID no. 114200
  misc_feature (113)..(288): Pfam Name: SKI Pfam Description: Shikimate kinase
  misc_feature (1)..(300): Functional Homolog of Ceres CDNA ID no. 23363195 at SEQ ID NO. 106 with e-value of 6.80E-77 and BLAST sequence identity of 54.7
MEARVSQSLQLSSWINSDKVVRKPSGLLRFSEKWNEKPRHRVVVSCHLQPRKAAHSDRRVQLKVSCSPQNVQASVLESGCFSASIDEIETLKNKAEEVEEYLDGRCVYLVGMMGCGKTTVGRILAETLGYSFFDCDRLIEQAVGGITVAEIFELRGESFFRDNETEVLHKLSLMHRLVVSTGGGAVVRPINWRHMHKGISVWLDVPLEALAKRITTEGTKSRPLLHEESGDVYDTTLKRLTTLMETRGENYANASARVSLENIALKREKDVCHITPAEITLEVLIQIENFLKTQKSVVVL

SEQ ID NO: 199 - DNA, 1248 bp, Panicum virgatum
  misc_feature: Ceres CLONE ID no.1769327
  misc_feature: Encodes the peptide given in SEQ ID NO. 200
ctccttcaattccctctcatctcgcgtctccgcacggagagccgccctcctcgtccgccgccgcctgccgccggcgagctcttcattaccccggcgatggccggcctatccaaaaccaccatcaccaatcacgtctagcacatctcgcccgagcggctgagccacacgtcacagcaacacatcaagccgcgcggatcgacaggaagatggaggcgagcgtgggcatccgggcgcggcccggtgcgtgggccgggctcgagaagccgcgcggcgcttgctctgcaagagtcccggcggcggggctcacggcggagaagctgccggcgaggctggctctgggaaccgatccgcggaggagcacggatcctgtgctccgtgccgcaaagatgaaagcttcgtgttgcaagaaatcgacaggtactgaaaaggtccactactctgccgatgaagctctcatactacagcaaaaagcccaggatgttctcccttacttggatggccgatgcatttatctagtcggaatgatgggttcaggcaaaactacagttgagaagatattagctgaagtactaggttattctttcttcgacagtgataagttggtagagaaggctgtcggtatatcatctgttgctgagatttttcagctccacagtgaagcattcttcagagataatgagagtgaggtcctaagggatttgtcatcaatgcatcggttagttgttgcaactggaggtggtgccgtgatccgaccaatcaattggagttacatgaagaaagggctgactgtgtggttagatgttccactggatgcacttgcaagaaggattgctgccgtgggaactgcatctcggcccctcttgcatcaggaatctggtgacccatatgcaaaggcttatgcaaaacttacatcactttttgagaaaagaatggactcgtatgctaatgcggatgccagagtttcacttgaacatattgcattaaaacaagggcataatgatgtcactatacttacacctagtaccattgccattgaggcattattaaagatggaaagttttcttactgagaaggccatggtcagaaactgaccgcttgttgctggggaaaagggcaccaacagcatatggcccctgtttgtttaattgtgcttgtacatatgcctttgcatgagctctttacagtactgttagattgttgttcatgcaacatgaaagatgattattcgaaaaaaaaaaaaaaaaaaaa

SEQ ID NO: 200 - protein, 294 aa, Panicum virgatum
  misc_feature: Ceres CLONE ID no. 1769327
  misc_feature (107)..(282): Pfam Name: SKI Pfam Description: Shikimate kinase
  misc_feature (1)..(295): Functional Homolog of Ceres CDNA ID no. 23363195 at SEQ ID NO. 106 with e-value of 2.79E-64 and BLAST sequence identity of 53.0
MEASVGIRARPGAWAGLEKPRGACSARVPAAGLTAEKLPARLALGTDPRRSTDPVLRAAKMKASCCKKSTGTEKVHYSADEALILQQKAQDVLPYLDGRCIYLVGMMGSGKTTVEKILAEVLGYSFFDSDKLVEKAVGISSVAEIFQLHSEAFFRDNESEVLRDLSSMHRLVVATGGGAVIRPINWSYMKKGLTVWLDVPLDALARRIAAVGTASRPLLHQESGDPYAKAYAKLTSLFEKRMDSYANADARVSLEHIALKQGHNDVTILTPSTIAIEALLKMESFLTEKAMVRN

SEQ ID NO: 201 - DNA, 745 bp, Musa acuminata
  misc_feature: Ceres CLONE ID no.1728680
  misc_feature: Encodes the peptide given in SEQ ID NO. 202
gctctcgtcgctaccgcaatggcagcatcacatggttggctcacttctctgcccaaccaattggctgtcgcaagctctgtcgtcaaccatcgatccgctgcggctgcttcgttcgtcgtcagggcgagctcgacggatgcatcacttacggagaaggattgtttaaggagaaggcaggttttagttggactcagttccttgaccgctgctttgtcccgggcaaattttgcaagtgctgaagatataccggagaattttcgagctttcgtggattttacagatggatatgcatactattatccttccgattggagagattttgattacatgggccatgattcagcatttaaagatcgatttgcagcattgcaacatgtcagagtcagtttcattcctaccgaaaagaaagatattcgtgatttgggatccatggaggaggtcattttcaacttggtaaaaaatatttatgctgcaccaaatcagattccgagcatatatgagatgcaggagcgaactgtcgatggaaagaactattggacattcgaatacgaacttgaatccccaagcttttcccgtactgcctttgcgacaatagctattggcaatgggcggtactacacattagttgttggtgcaaatgagaggcggtggactagacttcggaacaagctcaaggtggtagcagactctttcaagattcttgacatatgaaactagaagtgcttgcctgccgaaccatgagtcc

SEQ ID NO: 202 - protein, 230 aa, Musa acuminata
  misc_feature: Ceres CLONE ID no. 1728680
  misc_feature (48)..(228): Pfam Name: PsbP Pfam Description: PsbP
  misc_feature (1)..(231): Functional Homolog of Ceres CLONE ID no. 16403 at SEQ ID NO. 146 with e-value of 1.10E-58 and BLAST sequence identity of 60.2
MAASHGWLTSLPNQLAVASSVVNHRSAAAASFVVRASSTDASLTEKDCLRRRQVLVGLSSLTAALSRANFASAEDIPENFRAFVDFTDGYAYYYPSDWRDFDYMGHDSAFKDRFAALQHVRVSFIPTEKKDIRDLGSMEEVIFNLVKNIYAAPNQIPSIYEMQERTVDGKNYWTFEYELESPSFSRTAFATIAIGNGRYYTLVVGANERRWTRLRNKLKVVADSFKILDI

SEQ ID NO: 203 - DNA, 842 bp, Gossypium hirsutum
  misc_feature: Ceres CLONE ID no.1807796
  misc_feature: Encodes the peptide given in SEQ ID NO. 204
atggcagtggcaatggcgatgaattcagtttcattgaactgggttccaccttcctttacaaagaaggcaaattatgtgacaaactccactgagctagccccaccttctgctttttcttcgcaaaactcactcacgtacaccaaagaaaccatttccaatgaagaaaacaattgcaagagaagactgttgctcttgggtgttggagttattacagctaatttactccctgcaaattcccttctagcagaagagataccacaaaactatcgagcttttgttgacattccagatgggtattcttattactacccatcagattggagggaatttgattttaggggacatgattcagcattcaaagacaggtttcttcaactgcaaaatgtaagggtgagattcataccaactgataagcaagacatccatgagttggggccaatagaagaggttgtttacaatttggtgaatcatgtttatgctgcaccaaatcaaatggtcaatatacttgatatgcaagagagaacaagtgatgggaaaaactattatacctttgaatatgaactcacctctccaaactatgctagtgcttcctttgcaacaatagctattggaaatgggagatattacacactggttgttggagcacttgaaagacggtggagaaggcttcgaaacaagctgaaagtggtggccgactccttcaaggtgcttgacatctgatgaccccccaacttatcttttcattgtatataaaccccgaaacataccattggttttgtttagttgagcgtcatcgtcaactttaactatttctccttcttcaaaaaaaaaaaaaaaaaaaa

SEQ ID NO: 204 - protein, 235 aa, Gossypium hirsutum
  misc_feature: Ceres CLONE ID no. 1807796
  misc_feature (51)..(233): Pfam Name: PsbP Pfam Description: PsbP
  misc_feature (1)..(236): Functional Homolog of Ceres CLONE ID no. 16403 at SEQ ID NO. 146 with e-value of 5.30E-70 and BLAST sequence identity of 59.1
MAMNSVSLNWVPPSFTKKANYVTNSTELAPPSAFSSQNSLTYTKETISNEENNCKRRLLLLGVGVITANLLPANSLLAEEIPQNYRAFVDIPDGYSYYYPSDWREFDFRGHDSAFKDRFLQLQNVRVRFIPTDKQDIHELGPIEEVVYNLVNHVYAAPNQMVNILDMQERTSDGKNYYTFEYELTSPNYASASFATIAIGNGRYYTLVVGALERRWRRLRNKLKVVADSFKVLDI

SEQ ID NO: 205 - DNA, 883 bp, Panicum virgatum
  misc_feature: Ceres CLONE ID no.1771837
  misc_feature: Encodes the peptide given in SEQ ID NO. 206
ataactgatgctgggatacaagcgtcagagaacacttcctcgagctcagtgctatcctaaactactgaagaaatggcaagcctgcagaatctgatttgctccgtatctaaacaactggttgcgccaaattttgcggtgactgccaaactgaatggggcttctcactctgttgtcccagcaagctcaagcggagcatcttcgcatgaaaagaatgtcacgaaaaggcagttagctttgcttggtgctggagcattagccaccggcctactgaagacaagctccgcatttgctgaagaagtacctaagaattacaagtcttacgtggatgcaaaagatggatattcgtatctttatccagccgagtggagggatttcgacttcttgggtcatgattcagcattcaaagatcgtaatctggctcttcagtgtgtccgtgtggggtttattcctactgataaaacagatattcgcgacctaggaccaatggatgaggccatcttcaatttggtaaacaacgtttacgctgccccaaatcaaaaaccgtcgatctatgacatgcaagagcgcacggtggacggcaagaactactggacgttcgagtacgatctggaggctccgggctacggcgtatccgcgttcgcgacagtcgccattggaaacggtcggtactacacgctgatcgtgaccgcgaacgaacgccggtggagcaggctccggaacaggctcaaagtcgtcgcggactctttcaagatctccgacctgaccgcgtgaccgccagcgttctcgttaactgtaatggacggtctcattcagtcatggtatatatacttacgcgcgccataatcgtgcgtgtttcatttgctaaaaaaaaaaaaaaaaaaaa

SEQ ID NO: 206 - protein, 232 aa, Panicum virgatum
  misc_feature: Ceres CLONE ID no. 1771837
  misc_feature (73)..(228): Pfam Name: PsbP Pfam Description: PsbP
  misc_feature (1)..(233): Functional Homolog of Ceres CLONE ID no. 16403 at SEQ ID NO. 146 with e-value of 6.49E-56 and BLAST sequence identity of 52.3
MASLQNLICSVSKQLVAPNFAVTAKLNGASHSVVPASSSGASSHEKNVTKRQLALLGAGALATGLLKTSSAFAEEVPKNYKSYVDAKDGYSYLYPAEWRDFDFLGHDSAFKDRNLALQCVRVGFIPTDKTDIRDLGPMDEAIFNLVNNVYAAPNQKPSIYDMQERTVDGKNYWTFEYDLEAPGYGVSAFATVAIGNGRYYTLIVTANERRWSRLRNRLKVVADSFKISDLTA

SEQ ID NO: 207 - DNA, 841 bp, Gossypium hirsutum
  misc_feature: Ceres CLONE ID no.1853106
  misc_feature: Encodes the peptide given in SEQ ID NO. 208
aagcacggattcaaagtgataaaaaaaaaatccttcattttgcaggaaaaaaaatggctgatttggattcttcaagctcttcctctgaagatattgaaacaaactctgatcctaattcgtcaaaagctataatccccaatcctctcaattccaattctaattcacctgccgtatgcctcctccaattcgcaggagactccaccgctggtgccttcatgggctccatcttcggctacggttcgggattgattaaaaagaagggttttaaaggatcctttgtggaggctggatcttatgccaagacatttgcagttttgtcgggtgtacacagtttggtcgtttgcttcttgaagaggttgcggggaaaagatgatgttattaatgctggggtagctggatgttgcactgggcttgctctaagtttcccaggtgcaccccaggcacttatacagagctgtctcacatttggggcattctcatttatcgttgaagggcttaacaagcagcagccagcattggcacattcattttctgtgagaaacaagagcgggcactatgaggggcctcatcctatagcgctccctctttcactccctattccagatgagctgaaaggagctttttcttctttctgcaggtccttaagtaaaccaaatgaaggcaagttttctactggtaactgatgggaaggggccattcatcagtgttaatcgtctgttatatgtagattgttgattgttgcgagtgttgggagttacaatgtaagaatgtagaatcaaaattatctgagagctaggaaatgggaaattgttttttgtcctaaaaaaaaaaaaaaaaaaaa

SEQ ID NO: 208 - protein, 209 aa, Gossypium hirsutum
  misc_feature: Ceres CLONE ID no. 1853106
  misc_feature (34)..(152): Pfam Name: Tim17 Pfam Description: Tim17/Tim22/Tim23 family
  misc_feature (1)..(210): Functional Homolog of Ceres CLONE ID no. 965405 at SEQ ID NO. 172 with e-value of 5.20E-63 and BLAST sequence identity of 71.4
MADLDSSSSSSEDIETNSDPNSSKAIIPNPLNSNSNSPAVCLLQFAGDSTAGAFMGSIFGYGSGLIKKKGFKGSFVEAGSYAKTFAVLSGVHSLVVCFLKRLRGKDDVINAGVAGCCTGLALSFPGAPQALIQSCLTFGAFSFIVEGLNKQQPALAHSFSVRNKSGHYEGPHPIALPLSLPIPDELKGAFSSFCRSLSKPNEGKFSTGN

SEQ ID NO: 209 - DNA, 867 bp, Gossypium hirsutum
  misc_feature: Ceres CLONE ID no.1899181
  misc_feature: Encodes the peptide given in SEQ ID NO. 210
aggcacgtcgagaaagggggaaaaggaactcatagtagtttttggacaaaaatggctacttcggattctccaaacacttcagctggatctgatattgaaacaaaccctaatcctaattcttcaaaagccataatcctaacaccatccaattccaattcccctgccgtatgcctcttccaattcgcaggagactccgccgccggtgccttcatgggctccatctttggctacgggtcaggattgattaaaaagaaaggctttaaaggatcctttgtggaggcaggatcttacgccaagacatttgcagttttgtccggcgttcacagtttggttgtttgctttttgaagaggcttcggggaaaagatgatgttattaatgccggtgtagccggatgctgcactggacttgctctaagtttcccaggtgcacctcaggcacttctacagagctgtctcacctttggggcattctcatttatcatcgaagggcttaacaagcagcagccagcattggcacattcattttctgcgagaaacaagagtgcacaccacaagggacctcgtcctttagcactacccctttctatccctattccggatgagctgaaaggagctttttcttcgttctgcaagtccttggtaaaaccaaataaaggtaggtttcctacaggtaactaagtagtaggtggaccatttttcatttttcctgttgtttgtagaattttgcaagtgttgagaatgtagactgaaagttttgtctgagatttgaagctttttacaagcagaaagatgaaattgcttcttttcttgtgttgattcaattatattatctgtctggttcagtagtaaaaaaaaaaaaaaaaaaaa

SEQ ID NO: 210 - protein, 208 aa, Gossypium hirsutum
  misc_feature: Ceres CLONE ID no. 1899181
  misc_feature (33)..(151): Pfam Name: Tim17 Pfam Description: Tim17/Tim22/Tim23 family
  misc_feature (1)..(209): Functional Homolog of Ceres CLONE ID no. 965405 at SEQ ID NO. 172 with e-value of 4.09E-63 and BLAST sequence identity of 71.2
MATSDSPNTSAGSDIETNPNPNSSKAIILTPSNSNSPAVCLFQFAGDSAAGAFMGSIFGYGSGLIKKKGFKGSFVEAGSYAKTFAVLSGVHSLVVCFLKRLRGKDDVINAGVAGCCTGLALSFPGAPQALLQSCLTFGAFSFIIEGLNKQQPALAHSFSARNKSAHHKGPRPLALPLSIPIPDELKGAFSSFCKSLVKPNKGRFPTGN

SEQ ID NO: 211 - DNA, 919 bp, Panicum virgatum
  misc_feature: Ceres CLONE ID no.1758700
  misc_feature: Encodes the peptide given in SEQ ID NO. 212
ggaacacgataacgagacggcaggtgggggaggagccgaggagggcttcaggggtttcagggcggagaggagaagatggcggcgaagcgcgagaccgagtcggacggcgaagagctcggcggcgaggcctccaaccctgcgagcggtggcgcgactccgccgcccctagccgcagctcccgtcgtctgcctcctccgctccgctggggacttcgccggcggcgccttcgtcggatccatcgtcggatatggacaaggcctgatcactaagaaaggtttcaagggttcattcagcaatgctgggtcctctgctaagacttttgcagttctatctggggtccagagtttggttgtgtgcttgctgagaaggctgcgtgggaaagatgacattgtcaatgctggtatagctggttgttgcactggcattgctttgagcttcccaggagcaccacaagcgttgcttcagagctgtgccacctttgcagcgttttcttgcatcatggaggggctcaacaagcagcaggctgcaatggctcacactcttggcacaactgcattgacggttgcgcatgataaaggaggtgtactgcccccattcacgcttccaccaattctggatgcatcagatgctttagcttcatgctgccaagccttagtaaagcctaagcactagactacaggataggggagagagacatgctgaagaaagatagcttcagttttcatttctttattatgttgacctagcatatctgcatatgtaaattttgcttctggacaagctgtggaacgtgcctaaaacctagttttgctttgagcaactggacaggttttcttgatgtgttcgtgttgcgaattccgctggttctggcattattaaaatcataaatacttgcctcgaaaaaaaaaaaaaaaaaaaa

SEQ ID NO: 212 - protein, 198 aa, Panicum virgatum
  misc_feature: Ceres CLONE ID no. 1758700
  misc_feature (31)..(149): Pfam Name: Tim17 Pfam Description: Tim17/Tim22/Tim23 family
  misc_feature (1)..(199): Functional Homolog of Ceres CLONE ID no. 965405 at SEQ ID NO. 172 with e-value of 3.10E-49 and BLAST sequence identity of 62.4
MAAKRETESDGEELGGEASNPASGGATPPPLAAAPVVCLLRSAGDFAGGAFVGSIVGYGQGLITKKGFKGSFSNAGSSAKTFAVLSGVQSLVVCLLRRLRGKDDIVNAGIAGCCTGIALSFPGAPQALLQSCATFAAFSCIMEGLNKQQAAMAHTLGTTALTVAHDKGGVLPPFTLPPILDASDALASCCQALVKPKH

SEQ ID NO: 213 - protein, 203 aa, Oryza sativa subsp. japonica
  misc_feature: Public GI ID no. 108706643
  misc_feature (35)..(153): Pfam Name: Tim17 Pfam Description: Tim17/Tim22/Tim23 family
  misc_feature (1)..(203): Functional Homolog of Ceres CLONE ID no. 965405 at SEQ ID NO. 172 with e-value of 7.40E-48 and BLAST sequence identity of 59.0
MAAKRGSESDGDELGGGGAAEGTSPNDGGASPPPLAAAPAVCFIRSAGDFAGGAFIGSIVGYGQGLFTKKGFKGSFSTAGSSAKTFAVLSGVQSLVVCLLRRLRGKDDIVNAGIAGCCTGLALSFPGTPQALLQSCATFAAFSCIMEGLNKQQAAMAQTLGGSALTVSHQNGGVLPPFTLPPLLDASDALSSCCQPLVLKPKH

SEQ ID NO: 214 - DNA, 1066 bp, Brassica napus
  misc_feature: Ceres CLONE ID no. 1096546
  misc_feature: Encodes the peptide given in SEQ ID NO. 81
atactctaaatagctcgatgccaaaaaatcagamtgattgaatagtttagttcgataccatcaataaacccgttgacccgatccaatgacccgctccgtgaacttccctctcctcggcctcgccgccgcactcctcctctcacctctcctcgccgtctctggtaaactcgccgacgacctcaagccaaaccgccaggaggtttayggcggaggkaagatattcgacatcagccaccgttacacgccggagatgccggcgtgggagtctaaggagggactttcgaaccacctgagactgatcgcgagtatgaagaacggatcgttcgctaacgtgtcggagatgaaactgtctgttcactccggaacacacgtggatgctccaggccacttcattgatgagtattacgacgctggtttcgattgcgattcgcttgacctccaaactctaaacggtcctgctttgttggttgatgttccgagagacaagaacataactgctgaggtaatggaatcmcttcatattccaaggggagttcgtcgtgtgctyttcagaacatccaacactgacaagcggcttatgtttaagaaagagttcgattcaagcttttctggattcatgactgatggggccaagtggttggttgagaacmcggacatcaaacttgttgggcttgattatctttcctttgctgcttttgacgagtcmccggcaactcacaaggttatacttagaggaagggatataatccctgtcgaagctytgaagctggatggtgttgaggcaggaatgtactcgcttcattgcttaccgctgagattggttggagcaraaggggcmccaaccaggkgcattctcatcaagtgattcagttcttccgtyttctttttaagttggtcagccaactgatcataaataatatgtttattacttccaagatcccmcaatcataaagcaggtatcatagatgagatgattccagttgtaaaagtaaacaatacctttatagacgtatgtgtatgtttgtatgtgtaattytgaaagatattgataataaagttaagactg

SEQ ID NO: 215 - DNA, 490 bp, Brassica napus
  misc_feature: Ceres CLONE ID no. 1311812
  misc_feature (263)..(263): n is a, c, t, g, unknown, or other
  misc_feature (332)..(332): n is a, c, t, g, unknown, or other
  misc_feature (362)..(362): n is a, c, t, g, unknown, or other
  misc_feature (405)..(405): n is a, c, t, g, unknown, or other
  misc_feature (429)..(429): n is a, c, t, g, unknown, or other
  misc_feature (448)..(448): n is a, c, t, g, unknown, or other
  misc_feature (454)..(454): n is a, c, t, g, unknown, or other
  misc_feature: Encodes the peptide given in SEQ ID NO. 82
aatatcagtttgattgatcatcataaaattgacagaccaataaaacattacgaacagaatactatatgaataccaaccaaggttcatgaatccacgttgacctacgaaccgagataatgattcctttcctcaccatcgccaggacactcttcctctcctctgtcatcgccgctgatgaagcttttccgtcgattcccactaccttccacgtagccatgacctcctctgacgatctgaaaccgatccgtcaggagggttatggngaaaggaagatattcgacataaacccaccggtacacgcaggatatgccggtctggggaatcgacagaangaggtaaaccggttcctgcgtctaaccacngagtatgaagaaaccaatcccctctctaataccctcgggagangaaaactatcttgttcacaccggntacacacccttggatggcnccaggnccacttttcatggacaaggtattaacgaacgctggg

SEQ ID NO: 216 - DNA, 1066 bp, Brassica napus
  misc_feature: Ceres CLONE ID no. 952461
  misc_feature: Encodes the peptide given in SEQ ID NO. 83
atactctaaatagctcgatgccaaaaaatcagactgattgaatagtttagttcgataccatcaataaacccgttgacccgatccaatgacccgctccgtgaacttccctctcctcggcctcgccgccgcactcctcctctcacctctcctcgccgtctctggtaaactcgccgacgacctcaagccaaaccgccaggaggtttacggcggagggaagatattcgacatcagccaccgttacacgccggagatgccggcgtgggagtctaaggagggactttcgaaccacctgagactgatcgcgagtatgaagaacggatcgttcgctaacgtgtcggagatgaaactgtctgttcactccggaacacacgtggatgctccaggccacttcattgatgagtattacgacgctggtttcgattgcgattcgcttgacctccaaactctaaacggtcctgctttgttggttgatgttccgagagacaagaacataactgctgaggtaatggaatcmcttcatattccaaggggagttcgtcgtgtgctyttcagaacatccaacactgacaagcggcttatgtttaagaaagagttcgattcaagcttttctggattcatgactgatggggccaagtggttggttgagaacmcggacatcaaacttgttgggcttgattatctttcctttgctgcttttgacgagtcmccggcaactcacaaggttatacttagaggaagggatataatccctgtcgaagctytgaagctggatggtgttgaggcaggaatgtactcgcttcattgcttaccgctgagattggttggagcaraaggggcmccaaccaggkgcattctcatcaagtgattcagttcttccgtyttctttttaagttggtcagccaactgatcataaataatatgtttattacttccaagatcccmcaatcataaagcaggtatcatagatgagatgattccagttgtaaaagtaaacaatacctttatagacgtatgtgtatgtttgtatgtgtaattytgaaagatattgataataaagttaagactg

SEQ ID NO: 217 - DNA, 1071 bp, Brassica napus
  misc_feature: Ceres CLONE ID no. 954851
  misc_feature: Encodes the peptide given in SEQ ID NO. 84
atcagtttgattgatcatcataaaattgacagaccaataaaacattacgaacagaatactatatgaataccaaccaaggttcatgaatccacgttgacctacgaaccgagataatgattcctttcctcaccatcgccagtacactcttcctctcctctgtcatcgccgctgatgaagcttttccgtcgattcccactaccttccacgtagccatgacctcctctgacgatctgaaaccgatccgtcaggaggtttatggcgaaaggaagatattcgacataacccaccggtacacgcaggatatgccggtctgggaatcgacagaaggagttaaaccgttcctgcgtctaaccacgagtatgaagaaccaatccctctctaatacctcggagatgaaactatctgttcacaccggtacacaccttgatgcaccaggccactttcatgacaagtattacgacgctggtttcgattcggattcgcttgacctccaagtcctacatggccctgccctgttggttgatgttccaagggataagaatatcactgrggttatgaaatcacttcatattccaaagggagttcgtcgtgtgctcttcagaacattgaacmctgataggcggcttatgtttaagaaagagttcgattcgagctttgctggattcatgatggatggggcgaaatggttggttgagaatacagatatcaaacttattgggcttgattatctttcttttgctgcttatgaggaagcgcctgaaacgcacaagtttatactaggagaacgggatataatccctgtggaagcgctgaagctggatggtgtggaggtaggagtgtactcgcttcattgcttaccgttgagattgcctggagcggaaggtgcaccaacgagatgtattctcatcaagtgattcagttcatctccttctctataagctagttgttcagtatacgaaagtgattataagaacaaaataaaggcttyttacttccaagatytggaacaatagagcatatgttacatatgtcaagaattttaaagttcaagattcacttggatacctttat

SEQ ID NO: 218 - DNA, 933 bp, Zea mays
  misc_feature: Ceres CLONE ID no. 1064137
  misc_feature: Encodes the peptide given in SEQ ID NO. 85
aacaatggcagttcctccacttctcctcctcacactcctctccctcccttctcttctcatccacgccgccatctccgatgcttaccccaccattcccggaaccgctccgatcgacggaggtttctccgatgaactcaaacccatccgccgtgaggtctacggcgaaggcaaaatcttcgacatcagccaccgctacacgccggagatgccggcgtgggagtcaaaagaaggaatcggacggtttctatggctagccgcgagcatgaagaacgggtcgctcgctaacaactccgagatgaagatcccgactcacactgggacccacgtcgattcgcctggacacgtgtacgatgagtattacgacgctgggttcgatgtagactcgcttgatctccaagtcttaaacggtcctgcgttgttggttgatgttccaaggaacaagaacataactgccgaagtgatgaagtctcttaacataccaagaggagtccgtcgtgtgcttttcagaacattgaatactgacaggcgtctgatgttcaagaaggagtttgatacaagctatgtcggattcatgaaggacggcgcacaatggttggtagacaacactgacatcaaacttgttggggttgattatctatcagtagctgcatatgatgatctgattccgtcccacctagtattcctaaaaggccgagagactatactggtggagggattgaagctggatgatgtgaaggcaggagtctactctgttcattgcttacctctaagacttgttggagcagaagggtctccaattcgctgcatcctcatcagttgatttcttcctccaaaacttggagttgtctgtatgcaagttaacctttcgtatctttacttcaagatcttatgcttgacaaaaaaaaaaagtaaaataaataaggaaacttggcg

SEQ ID NO: 219 - DNA, 1179 bp, Zea mays
  misc_feature: Ceres CLONE ID no. 368629
  misc_feature: Encodes the peptide given in SEQ ID NO. 86
aaaaactccccagtcaaggcgcatatccattccatggatctcgcgcccctgctccttctctcccagctgctgctgcttccggtggtggcggttgtctccggcgagaccgccgcgcacccgggctacacacacgctgaggaggcatgcagcggtgtgctagaggcagaggcggagaaagcaacggtgctggtgcctgcgccagagcggcgcgaagagttcgacggggggcggatcgtggacatcagccactactaccgcgaggacatgccggagtgggagtcatcagagggctccggcgagttcctgcagctggcgcgttccatgcgcaacggctccgacatcgctaacttctcggagctccggctcactgcgcactccggcacccacgtcgacgcgccgggacacgtcttcgagcactactacgacaccggcttcgacgtcgacaccctcgacctcgctgtcctcaacggaccagcgctgttggttgacgttcccagagataagaacatcacagctgatgttatggcatccctaaacatgcctaaaggtgttcgacgtgtactctttcggaccctaaatacagacaggatggtgcacaatggttggttgataatacagacatcaaactagttggagttgactacttgtcagtgggcgcatttgatgaatgcattccagctcatctagtatttcttgaaaaaagggaggtcatacttgtcgaagccttgaatctggagcatgttagccctggaatatacatcttgcattgcttgccactaagattgcggggtgctgaaggttctcctgcaagatgcatcctcatcaagtgacatggttataaccatcccaaaaagcattgtacaatcaatcttgaaacctacctattcagtcttttcgaagtgcttatagaagtatggttttcatgcgtgtgtttatagggatggtgtgaggacccaataatatggagctgggctagtactgatccaatcgacactaatatgagctgaagatactacataaaacatgaacaatatggagttttatatactggaccccagtccaggttttaaatccacccctgcaaggggtgaatttatgtttgtgtttgggagtgtatatttctatattgcagtttgaaaaaaactatgtatgtaataaaataagaatacatcaattcat

SEQ ID NO: 220 - DNA, 1195 bp, Glycine max
  misc_feature: Ceres CLONE ID no. 473732
  misc_feature: Encodes the peptide given in SEQ ID NO. 87
aaagtaaaccatgaattctctatcactcttcaccttcctctgcgcaatttgtgcgcactccgtcgccgtcacctccgcggcatatccttccatccccggcacggaaaccggagagtgctccctccgcggcgtcggcgtcggcgacggtgttctggtccctccgcggcgagaagtgtacgaggaggggcgaatcttcgacatcacccacaggtatgtccccgagatgccggtgtgggactcgacggaggggctcgggcagcacttcctgtggctcgaaaagagcatgaagaatggctcgcgcgctaacaactccaacatgaagctcggtgttcacaccggcacccatgtcgacgcgcccggtcacttttacgacaattactacgacgccggcttcgatgttgactcactcgacctaacactcctcaatggccttgcacttttggttgatgttccacgggataaaaacattactgctgaggttatgaagtccttgaatatccctagaggtgtaagccgcgtgcttttcagaactttaaacactgacaggcaactcatgtttaagaaagaatttgacacaagctatgtgggattcaaggaggatggtgcaaaatggctggcagagaacaccgacatcaaacttgtaggagtcgattacttatctgttgctgcttatgatcactccattccatctcatcttgttttcctggaaagcaaggaaatcattcttgtggaaggcctaaagcttgatgatgtcccagcaggaatatattcactgaattgcttgcctcttaggttggttcactctgaggcatcaccaattcgatgcattctgatcaaatgatcaaatgatggggtcaaacctggttttcaattgcacggatgaacctgccacaagaagcaacgtagccacgaatacaattagtggtgtccataagaagcagtttgatgcaaattgcaagctaagctgatagtagtatgttgaattactcttagtttacgtccttgggttggaaagtactgaattattgtgattaaacttcagttgcggactagggggtccacctgtattaacttatgcttttaatattttcctaggcaagtacttgtgcaattctgaagacgcatgcttgtacgtctcaataattatatctatttctctttgaaaaataatgaaatactactaataatctcgggc

SEQ ID NO: 221 - DNA, 1200 bp, Glycine max
  misc_feature: Ceres CLONE ID no.554272
  misc_feature: Encodes the peptide given in SEQ ID NO. 90
atgaatgagctaagtggaaagtgaaaacgtgcctctttactaacgaaaccaaagcatgaagatgaattgctactggtggcatgccctgataatgagtggttgtgtgttgggcttgtgcgtgggcataggaggttgtgtatgtgtggtggagaacgagaatggaagaatcatcattgatattagtcacaggtaccatcctgatatgcctgcctgggaatccaaggatagccttgggcagtttttgtggcttacaagaagcatggccaatggttctctggctaacttctcccaattcaagctccccgctcacagcggcacccatgtcgatgctcccggacatgttttcgatcactatttccattctggctttgatgtcgactctctcgatttactactccttaatggccctgcactattagttgatgttccaagagatacaaacatcagtgctggtgttatgaagtcattgaatattccgaggggcgtacgtcgtgtgctcttccgaacattaaatacttacaggcggcttatgtatcagaaggaatttgacacaagctatgtgggattcacagaagatggagcaaattggctagtggagaacactgacattaagcttgtgggaatagattatctatctgttgctgcttacgaccacttgattccagctcaccttgtttttctgaaaggcagggaaatcattctcgtggaaggcctgaagcttgatgatgtggcagcaggaatatatacggtccattgcttacctcttaggttggctggtgctgagggatcacccataagatgcattctcatcaaataataagtcaacagctagcagtccaaatgccgacacgacatgcagcagtggtttatgcttggaaatgggtcttaattacgagcataaggttgagtttcaatgtagttttcttaaatacgaataagttggaaaaataaatataaagtggtgtcccgtgtccatttggagcaaggtatcataaatgcttagcaaagtgcataaacgctcctacaaatcatttcagaaataaagcagtatggatattggatgatatataaagtactatgtaatatgcagtgaaggtataacaaatgtcaaatagcaattattcttgcgtacttttaaatacactatatggatggatgtttggaattattattttttaagaaggatgtttggaattgttt

SEQ ID NO: 222 - DNA, 1251 bp, Glycine max
  misc_feature: Ceres CLONE ID no.511015
  misc_feature: Encodes the peptide given in SEQ ID NO. 91
gatgcgaaaatatctcgttcatgttaatgttatgataacgaggaatggactatgatgctgttctgttggtgacggtgtgattgattgtgacgaaatctgacaatgaagcgtggagcattgttgtcagtgcttgcctgcgccttcgcggcggtgatctgggcagcgaacggcgacgacaacctcgtcccgcctcgccgggaagtgtacggcaatgggcgaatattcgacatcagtcatcggtaccaacccgagatgccggaatgggaatcgaatgacggcatagggcagttcctgtggcttcccaagagcatgaagaacggttccctcgccaacaactccgaaatgaagtttcccacccacaccggcacgcacgtcgatgcccccggtcacgtgttcgaccactacttccacgccggcttcgatgtcgacacgctcgacttggacatcctcaacggacctgctatgttggttgatgttccaagagatagtaatattaccgctcaagttatgaagtcgttgaatattccaaggggtgtaatacgtgttctcttccgaactttaaataccgaccggcggctgatgtttcagaaggaatgggactcaagctatgtgggattcacagccgatggagccaaatggctagtggagaacacagatatcaaacttgtaggaattgattacctatctgttgcttcttatgattacttgattccatctcaccttgtttttctaaaagacagggagatcattctcgtggaaggcttgaagcttgatgatgttccagcagggttatattcagtccattgcttacctcttaggttggctggtgctgagggatcaccaatacggtgcattctgattaaaaattagggtgtccacatgtctgtgttcggtgtccgcgtcggtgtcggtgcttcataggctggaactgataaattggcatgggggtgtggtgtccttatggagcaagatagtttcaatgttgtgcaacaacttttgtagcttatgtttacacttactaaaaacatgcataagcacttcaaaaaatcattttgaaaaggaaaataatgtatatatagataatttgcacatttcattagcacttcaagagagatgcaacgatattggcattgcgctgaatttggttttcttttgtctgctaggttggaaaggaataagttggcacaatggtgtctttatggagcaagatagtatcaataatgtttgttaaagaaaaaaaaaaaaaaaaaa

SEQ ID NO: 223 - DNA, 1173 bp, Triticum aestivum
  misc_feature: Ceres CLONE ID no.881632
  misc_feature: Encodes the peptide given in SEQ ID NO. 92
gaataacccgcacctatccacgacaccgagggagaggagcaactgatccccgacgccccaaatggcgcctcccctcctcctcctcctcctcgtccctctcgtcgccgccaccgcaccgtgcgcccacccggcccacccgagccagccggcgtcgtgcgccgcggagcccgtgctggcgccggagcgccgggaggcgcacggcgggggccgcatcctggacatcacccactactaccgggaggacatgccctcgtgggagtccggcgccggggtgggccagttcctctggctgcccgcctccatgcgcaacggctccctcgccaacaactccgagatgcggatgcccacccacaccggcacccacatcgacgcctccggccacgtcttccagcactacttcgacgctggcttcgacgtcgacaccctcgacctcgacgtcctcaacggtcctgcactgctggttgatgttccaagggatgaaaatattactgctaaaacgatggaatctttgcatattcctaaaggagttcaacgggtactttttagaacattaaacactgacaggaacctaatgtggaagaaagagtttgacacaagctatgtgggttttatgaaagatggtgcccaatggttggtagacaacacggatattaagcttgtcggaatagactatttgtccgttgcagctttcgatgacttgatcccttcacatttagttttacttgaaaaccgggatatcattcttgtggagggcctcaaactggagaatgtcatacctgggatatactcgttgcattgcctgccacttcggttgcgtggagctgaaggttcgccgatcagatgcatccttataaagtgaaagacatttgcatcccgctgcggcggtttagtttgataccgcaagcacttatatataaaaatagaatgtgtatagcagcaaaactcgtgtctttgataccagaggagtactgtcatgtgtccagaaacatggtggcacttcgatgcttagtaaggagcgacaaacggctagggatgcaaatgtgtagcctctagggtaccctccgaacctttagttgggctatagaagggatggattacaatacaaaccgcaatgttcggtggtaccaaaatcccaaaaaaaaaaaaaaaaaaaaaagaaaaaaaaaaaaaaaa

SEQ ID NO: 224 - DNA, 1347 bp, Glycine max
  misc_feature: Ceres CLONE ID no.474985
  misc_feature: Encodes the peptide given in SEQ ID NO. 103
aggaacagagcaaacatgctgcttctttggcttttgccactgctgttgctgcagaggctgctgttgccgctgctcaggctgctgccgaggttgttcgtctcacaagtatgccacattacactggaaggactaaggaagaaattgcagccatcaaggttcagactgcattccgtggatatatggcaagaagggcattgcgtgcgttgagaggattggtgaggttgaaaacattagtacaagggcaatctgttaaacggcaagctgctagcaccctacgaagcatgcaaactctagcaagattacagtctcagattcgtgaaaggagaattagaatgtccgaagagaaccaagctcttcagcgccaactacatcagaaacatgaaaaagaacttgagaagttgcgtgctgctgttggagaagaatgggatgatagctcgcagtcaaaggagcaaattgaagcaaaattgttgcacaggcaagaagctgctttgagaagagagagagctttggcctattcattctcacatcagcaaacatggaagggctcttcaaagtcattaaatccaacatttatggatccaaacaatccccaatgggggtggagttggctagagagatggatggctactaggccatgggatggccatagcactgtggtggatcacaatgaccatgcatctgtgaagagtgcagcgagccgtgccgtgtctgtagggcaaatcaccaaattgtactctctccaagataaaaaaccttccccttttggctcaaaagcaagaagacctgcccctcaaagttcccattcaaaggcaccatctactaatggaaaagcaaggccatcaagctcaacaaagggtagtagtgtttggggtggagatgaggactcaagaagcatgtttagtgttcagtcggagcgctaccgccgacacagcattgcaggatcctcagtgagagatgatgatagccgtgcaagcacacctgccattccaagttacatggcagccacaagctcagcaaaggccaggtccaaaatcataaggcattcacctgaaaaaaaaggtggtggtggttctgtttctgcaaggaagcgactttctttctcaccctcttctgctgctaattcaagaaggcattctgatcctcctaaggtggaaatggtttacaataaggatgctgctgcggctacagtaagcaatggaaggggaaggtagtgtgctggggatgtcattgccacttcagcaattcttgtaggagcacaatatctatggatctatttggataaacttctccataatcacttataaatgaagaaaaacaaaagtaatatagaaaaaaaaaaaaaaaaaa

SEQ ID NO: 225 - DNA, 1716 bp, Triticum aestivum
  misc_feature: Ceres CLONE ID no.826796
  misc_feature: Encodes the peptide given in SEQ ID NO. 104
ataggacttcacagacagactgactcaatcctaacccaatccctcccatgcttccatctactctagcagaaattgcagaggaggttggccgccgccggctccagcgcaggcgcagcctacccgcgggatctgacgccctccgcctcctacctcgaggcacgcgcctcaggctcagctcccccgcccgccctcccccgctaccccgacgacttccaagaggaggagcatgaaattgagcatgtcgccgccgcgccagcgccagcgccagccacggatgcgccgctacctgcccctcctgccgccgcaccaccacaggttcaggctgccattgcgccggcttcttcctcttgtgtcatgtccagggagctcgccgccaccaagatccagaccgccttccgaggtcacctggcaagaagggcgctgcgggcattgaaaggcctggtcagactcaagtcgctggtccaaggccactccgtcaagcgccaggccaccagcacgcttcgctgcatgcagactctgtcccgggtccagtccaagatacggacgaggaggatcaagatggccgaggagaaccaggcccttcagcgccagctcttgttgaaccaggaactagagactctcaggatgggagatcagtggaataccagcctgcagtccaaggagcaaatcgaggcgagcctcgtgagcaggcaagaggccgcggctagaagagaacgggctctcgcatacgcattctcccaccagtggaagagcacctcaaggtctgccaacccgatgttcgtggacccgagtaacccgcactggggctggagctggctggagcggtggatggcgtcgaggccgttcgacggccgcaacggggcgtccgagaaggagggcagcagcgtcgaccgcacgtcggtgcacagcaccagcctgagcatgaacctcggagaaggtgagacggtcacaaaggcggacaaccaggtggtggactctttgaagccgaatgatgataagccgccgccgctttcgactccgaagccgtccggccctgcccccaggcagtccccgtcgacgccctcgccggcgctggcgaggaagaagagcgcgacgcccaagagtggagactgcgacggcgacgacgcgaggagcgtggtcagcactgtccggtccgagcggccccggaggcacagcatcggcgcgtccagcgtgcgtgacgacgcgggctcttccccgtcggtgccgagctacatggcggccaccaagtcggcgtcggccagggccaagtcgcgtgtgcagagcccgacgctgaccgagggtgctgctcaagctgagacgctggagaaaggatggtcttctgtgggttcagcgaagaagcggctgtcctttccggctgggacgccaccgccggtgccggcggcggcggcgaggcggcactccgggcctcccaaggtgcggcaggcgggcgtggaaggtggtacggaggaacgggactcgtcccttgcgtgacatcatgggaagcagattatggtgtggagcagagcagagcggaatttgttgcatttgttgagtgaaaggaacgcagaatgtgtgttgtgtggatccattggatttgatttgatttgtatgatggcagtattcctatttgattattcattgaataatataagtatctgtaatgaagataaaaggaggggacacgaacattatttcaaaagaaaaaaaaaaaaaaaa

SEQ ID NO: 226 - DNA, 1381 bp, Glycine max
  misc_feature: Ceres CLONE ID no.463638
  misc_feature: Encodes the peptide given in SEQ ID NO. 107
attagattctgcttccatttttttttttctctctacacctcttcttcttcacttcctctttactgtttgttacttcaattttgtgattcgttctttctggattcaattgagtaaaaatctgcgtggtttgagcaatggatgttaaagctgcgccgaggttacaactttcagcggtggttcaacccgaaagtattggaagaagaccacccagcacatgtcgtttgggtgtgtctcgggaaccgcagagccttcgggtttttgtttcgtcaacgatgatgcgccgcagaacaaccgctttggaggtttcctgttcttacggcaacatttcagcttcaatattggaatctggaagtgttcgtgctcctcttgatgaagagctgattctaaagaatagatcgcaagagatccagccatatttaaatggacgctgtatttatcttgttggaatgatgggctctgggaaaacaacggtggggaagataatgtcacaagtgcttggttattcattttgtgatagtgatgcattggtggaggaggaggttggtggaaactctgtagctgatatattcaagcaacatggtgaaactttctttcgtaataaggagactgaggtgttgcataagctatccctgatgcatcaacttgttatttctactggtggaggtgctgttacaaggcccatcaattggaaatatatgcacaagggagttagtgtttggttggatgtaccagtggaagccctggcacagagaattgcagctgtaggaactaattctcgcccccttctacactatgaagcaggagatccttacacacgggcttttatgcgtttgtctgctctttttgaagagagaggtgaagcatacgccaacgccaatgccagggtctcattaaaaaatatagcaataaaactgggcaaaagagatgtgtccgaattgtctccaacagatattgcaattgaggcgctagaacaaattgacaactttttgaagggggaagggggccgctatgcagaatgctagtacaagctttggttacaagcttctttttgattgttcatatttttttttatgcaattgcgattaaggtcatgctgtcgacctcgcttttggtaaaaaaaaaaaaaaggtggtaatgcaacatggcacttgtttatgcataatttgtgttggcaaatgggcaaaatccaacagccaattgcaacaacatttaatttatgttctgtttattgttgaatgttgatgtgtgtgtgtatatatactggagaacgaagtgttgtaatcggagttgggttgatcaatttatgtatgccctcctctaaagaggtttgtatgttgtaaagtgacacgcatattttaaattcttctttatcttatatttg

SEQ ID NO: 227 - DNA, 1542 bp, Zea mays
  misc_feature: Ceres CLONE ID no.1565097
  misc_feature: Encodes the peptide given in SEQ ID NO. 110
aagtcgtagccgactggtcgccgcgtccccctttccccgcgcagcagcagagcaccatccggtgaccgagcaatggaggcggggggcgtgggcctggcgctgcagacgcgggcggcggccttcggctccggccagcgccggggcggcctacagtcgcccatcgggaggctgagagtcgctgaaccggcgggagctgcggttgccgtgcgggctcgcgggtccaagcccgtcgtaccgctccgtgcgaagaaatcatccggaggtcatgaaaacttgcataactccgttgacgaagctctcctgttgaagagaaaatcagaagaagttctgttctacttaaacgggaggtgtatttacttagtgggaatgatgggttctggaaaaagtactgtggggaagatcatgtctgaagtcttgggttattcgttctttgatagtgacaaattagtggagcaagctgttggaatgccttcagttgctcaaatattcaaagttcacagtgaagccttctttcgggataatgagagtagcgtcttgagggatctgtcctccatgcgacgattagttgttgccaccggaggtggtgctgtcatccgaccagttaactggtatctagagttcactccatttctttcttttaaatgggtcgctttgttttctttgaatcaacagtattgtgacctgtcgttccattatcaggaaatatatgaagaagggcctatccgtttggttagatgtgcccttggatgctcttgctaggcgtattgctaaagtgggaaccgcttctcgtcctcttctggaccaaccgtccggtgatccatacacaatggtagctacttattctttcaatattctttcatgctcgtgaaacggaattgtttcttcattctatttggacaaagaactgctcatagatccacttgagccttgaagccctatcctggattccagtcctttacttgtggacttgtggtagcaaatgctcagacttcttatgctagttctaatatggatcactcactgggttccttatttgttataggccttttctaagctcagcatgcttgcagagcaaaggggtgatgcttatgcaaatgcggatgtaagggtttctctggaagagattgcatctaaacaaggtcatggcgatgtctctaagctgatgccgactgatatcgcaattgaggtaagcttaccgcgaatatcatgtctctttccagataccatcagacagcttttcaaaagataacacgcttaccgtcttcgcagtcacttcataagatcgagagtttcgtcatcgagcacgctgctgataatccagctagcgactcgcaagctgagtcacagatccaaaggatacagaccttgtaatatcttaatccttctgttttgtaccgaagcgtaccccctagagcatcgttgggttatttgttcgttgaagtgtcacgagggagagaaaaaaaaaaccctgaagtatttcttgttgtaagttgtaaaggaatggaataaaggagctaataatccgaaaaaaaaaaaaaaaaa

SEQ ID NO: 228 - DNA, 1283 bp, Zea mays
  misc_feature: Ceres CLONE ID no.486613
  misc_feature: Encodes the peptide given in SEQ ID NO. 111
gtcactgctttacgtcccaacaggcggcacatttccgccaccagctaccaccgcctgcgcgcagcgcggtcctctctctcctcttctttacacctcacctccggatcgctcagagattgagccgtagcccgactggtcgccgcgtcccctccccccgcgcagcagcagagcaccacccggcgagcgagcaatggaggcggggggcatcggcctggcgctgcaggcgcgggcggcgggcttcggctccggctccggccggcgccggggcggcctacaggcgcccaccgggagcttgagagtcgctgatccggcgggacctgcggtcgctgtgcgggctcgcgggtccaagcccgttgcaccgctccgactccgtgcgaagaaatcgtccggaggtcatgaaaactcgcacaactccgttgacgaagctctcctgttgaagagaaaatcagaagaagttctgttctacttgaacgggaggtgtatttacctagtaggaatgatgggttctggaaaaagtactgtggggaagattatgtctgaagtcttgggttattcgttctttgatagtgacaagttagtggagcaagctgttggaatgccatcagttgcccaaatattcaaggtccatagtgaagccttctttcgggataatgagagtagtgtcttgagagatttgtcctccatgcgacgattagttgttgccaccggaggtggtgctgttatccgaccaattaactggagatatatgaagaagggcctatctgtttggttagatgtgcccttggatgctcttgctaggcgtattgctaaagtgggaactgcctctcgtcctcttctggaccaaccatctggtgatccgtacgcaatggccttttctaagctcagcatgcttgcacagcaaaggggtgatgcttatgcaaatgcagatgtaagggtttctctggaagagattgcatgtaaacaaggtcatgatgatgtctctaagctgacacctactgatattgcaattgagtcacttcataagatcgagagcttcgtcatcgagcacactgctgatagttcagctagcgacgcgcaaactgagtcgcagatccagaggatacagaccttgtagaaccttaatccctttgtttgccacatagagcatcgttgagttatttgttcgttgcagcgtcacgagggagagaaaaaagagtgaaacgtttcttgatgtgagttgtaaaggaatggaagaagggagctaataatccaaagtgtgccgttggctaaaaaaaaaaaaaaaa

SEQ ID NO: 229 - DNA, 1403 bp, Triticum aestivum
  misc_feature: Ceres CLONE ID no.749796
  misc_feature: Encodes the peptide given in SEQ ID NO. 112
gcgatctcccaaccccccctttacctcttctgtctcttcttccctccgccgcggcgccgctcgccacgccacccgcgtatccatccaccaccgttcccgcgatggccgccggcgtactcaacacccagccccgcctcaactaaccacggatgatacacatagctcctgttaacttcctgccactcgtcccgtcccccctgagggagaggagatggacgccggcgtgggtctccggccaaggccccgtgcagcatgggccggacgacggaagccgcagggattccccccggcgacggtgccggcggtgaggctcgaccagaatccggcgcggcggccgctggttctgcgctccgacgcggggagccggagcaccgatcccatccgtggcgccagcctcaagggcctgtgctgccacaaatcggcaggtaccgagaaagtccactattctgctgatgaggccctcgtactgaagcaaaaagcagaggatgtgctcccttacctgaatgaccgctgtgtttatctagttggaatgatgggttctggcaaaactacagttgggaagataatagctgaagtactaggctattcattctttgacagtgataagctggttgagcagtctgttggcataccgtcggtggctgagatttttcaggtccacagtgaagcattcttcagagataacgagagtgaggtactaagggatttgtcgtcaatgcaccgattaattgttgcaacgggaggtggtgcggtgatacgaccaatcaattggagttatatgaagaaaggactcactatttggttagatgttccattggatgccctcgcaagaaggattgctgcggtgggtactgcgtcacgacccctcctgcatcaggaatctggtgatccttatgcaaaggcctatgccaaacttacagcactttttgaacaaagaatggattcatatgctaatgctgatgcccgagtttcccttgaaaatattgcactcaaacaaggacataatgatgtgaatgtacttacaccaagtaccatcgctattgaggcattgctaaagatggagagctttcttactgagaaggccatggtcagaaactgaccagatctcggtggttaaaaagaaagatgacaaccaatggttcttggttgccgtgatgtacatacctttgcataagacattcttcttgatatagccagagctatgacagaggataacttgggtttttacttgagtgaactatatgtgaatagctctaaattaagacaatgtttgtcttgtctttatcttgctgcaatttgatatatgggatttgggagtaaatattaagtgatatcccttgtacattttgaagcaaccagaatttacatcaatatattattttgagacaaaaaaaaaaaaaaaa

SEQ ID NO: 230 - DNA, 1347 bp, Zea mays
  misc_feature: Ceres CLONE ID no.294723
  misc_feature: Encodes the peptide given in SEQ ID NO. 114
ctgattcctgaacacaccctcgtctccgcacggaggccgtcctctcctctcctctcctctgcgtccgccactgccgcccaccgctcgcccacgcgcgctccattacctcggcgggcgatggccgacctatccaacaccggctccacctaacacgagcagcgcccccgcctaggcggctggctggtcggtcgtcgagcagctagcggcggcagcgcccggaggccgtctcactctcctcgtcggggcggcaggagatggaggccatcgtgggcgtccgcgcgccgccgcgtggccgtgcctgggccggcctcgagaagccgccgcgcgccgcttgctgcgccagagtcccgacggcgaggctcgcggtcgcggcggacaggccgcggaggctggtgctgctgggcgccgatacgcggagggccgcggattatcctgccctccgttgcgccgcgcaatctgcaggaacaggaaaggtccactactctgctgatgacgctctcatactacagcaaaaagcccaggatgttctgccttacttggatggccgttgcgtttatcttgttggaatgatgggttcaggcaaaactacagttgggaagatactatccgaagtgttaggttattcgttcttcgacagtgataagttggtagagaaggctgttggtatttcatctgttgctgagatctttcagctccatagcgaaacattcttcagagataatgagagtgaggtcctgacggatctgtcatcaatgcatcggttggttgttgcaaccggaggtggtgcagtgatccgaccaatcaattggagttacatgaagaaagggctgaccgtatggttagatgtcccactggatgcacttgcaagaagaatcgctgctgtaggaaccgcgtctcgaccactcttgcatcaggaatccggtgatccttatgcaaaggcttatgcaaaacttacgtcactttttgagcaaagaatggactcgtatgctaatgctgatgccagagtttcacttgaacatattgcattaaaacaaggccataatgatgtcactatacttacacctagtaccatcgccattgaggcattgctaaagatggaaagttttcttaccgagaagaccatggtcagaaactgacctcttgaatgagagggaaaggatgctgacaacatgtggcccttgtttgtttaattgtacatatacctttgcattattgcctaaactctttctacagtgttgttggattattgtttgtgcagcatgaaagaggaccgtttgagtttgtatttatgcaaatgaataagtaaataactttcagttaaaacaatgacaattcgttatttatcgc

SEQ ID NO: 231 - DNA, 1318 bp, Zea mays
  misc_feature: Ceres CLONE ID no.1374869
  misc_feature: Encodes the peptide given in SEQ ID NO. 116
ctcctgaacacaccacccctcgtcgcacgacgatggaggccgtcctctcctctcctctgcgtccgccactgcccaccgctcgcccgcgcgcgctccattacctcggcgggcgatggccgacctatccaacaccggctccacctaacacgagcagcgcccccgcctaggcggcagctggctggtcggtcgtcgagcagctagcggcggcagcgcccggagggaggccgtctcactctcctcgtcggggcggcaggagatggaggccatcgtgggcgtccgcgcgccgccgcgtggccgtgcctgggccggcctcgagaagccgccgcgcgccgcttgccgcgccagagtcccgacggcgaggctcgcggtcgcggcggacaggccgcggaggctggtgctgctgggcgccgatacgcggagggccgcggatcctgccctccgttgcgccgcgcaatctgcaggaacaggaaaggtccactactctgctgatgacgctctcatactacagcaaaaagcccaggatgttctgccttacttggatggccgttgcgtttatcttgttggaatgatgggttcaggcagaactacagttgggaagatactatccgaagtgttaggttattccttcttcgacagtgataagttggtagagaaggctgttggtatttcatctgttgctgagatctttcagctccatagcgaaacattcttcagagataatgagagtgaggtcctgagggatctgtcatcaatgcatcggttggttgttgcaaccggaggtggtgcagtgatccgaccaatcaattggagttacatgaagaaagggctgaccgtatggttagatgtcccactggatgcacttgcaagaagaatcgctgctgtaggaaccgcgtctcgaccactcttgcatcaggaatctggtgatccttatgcaaaggcttatgcaaaacttacatcactttttgagcaaagaatggactcgtatgctaatgctgatgccagagtttcacttgaacatattgcattaaaacaaggccataatgatgtcactatacttacacctagtaccatcgccattgaggcattgctaaagatggaaagttttcttaccgagaagaccatggtcagaaactgacctcttgaatgagagggaaaggatgctgacaacatgtggcccttgtttgtttaattgtacatatacctttgcattattgcctaaactctttctacagtgttgttggattattgtttgtgcagcatgaaagaggaccgtttgagtttgtatttatgcaaatgaataagtaaataattttcagtt

SEQ ID NO: 232 - DNA, 1234 bp, Zea mays
  misc_feature: Ceres CLONE ID no.276706
  misc_feature: Encodes the peptide given in SEQ ID NO. 118
caccggctaccacctgccgcctgcgccctgccctccctctgtttttctagacccccggatcgctcagagattgagtcgtagtcgcacccgactagtcgccgcgtcctcctttccccgcgcagcagcagagcaccacccggtgaccgagcaatggaggcggggggcgtgggcctggcgctgcagacgcgggcggcggccttcggctccggccagcgccggggcggcctacagtcgcccatcgggaggctgagagtcgctgaaccggcgggagctgcggttgccgtgcgggttcgcgggtccaagcccgtcgtaccgctccgtgcgaagaaatcatccggaggtcatgaaaacttgcataactccgttgacgaagctctcctgttgaagagaaaatcagaagaagttctgttctacttaaacgggaggtgtatttacttagtgggaatgatgggttctggaaaaagtactgtggggaagatcatgtctgaagtcttgggttattcgttctttgatagtgacaaattagtggagcaagctgttggaatgccttcagttgctcaaatattcaaagttcacagtgaagccttctttcgggataatgagagtagcgtcttgagggatctgtcctccatgcgacgattagttgttgccaccggaggtggtgctgtcatccgaccagttaactggaaatatatgaagaagggcctatccgtttggttagatgtgcccttggatgctcttgctaggcgcattgctaaagtgggaaccgcttctcgtcctcttctggaccaaccgtccggtgatccatacacaatggccttttctaagctcagcatgcttgcagagcaaaggggtgatgcttatgcaaatgcggatgtaagggtttctctggaagagattgcatctaaacaaggtcatggcgatgtctctaagctgatgccgactgatatcgcaattgagtcacttcataagatcgagagtttcgtcatcgagcacgctgctgataatccagctagcgactcgcaagctgagtcacagatccaaaggatacagaccttgtaatatcttaatccttctgttttgtaccgaagcgtaccccctagagcatcgttggtttatttgttcgttgaagtgtcacgagggagagaaaaaaaaaaaccctgaagtatttcttcttgtaagttgtaaaggaatggaataaaggagctaataatccgaagtgtaccgttggccg

SEQ ID NO: 233 - DNA, 1254 bp, Triticum aestivum
  misc_feature: Ceres CLONE ID no.840744
  misc_feature: Encodes the peptide given in SEQ ID NO. 119
accactcgccgccccccagcagccaccggacacctgccgaaagcgcgagagagccgtagccgatcgcatcgccgcgtagtggccgccgcagagcaaccggcgagcaatggaggcgggcgtggggctggcgctgcagtcgagggccgcggggttcggctccggccgccgccggagctcgatgtacggcggcgagagcggggctcgggtcgtgagcttgcgggtcagtgatctggtggggtcgccggccgccgtgcgggcgcgcggggccaagcccgtcgtcccgctccgcgccaagaaatcgtccggaggaggtcatgagaacttgcataactccgttgacgatgccctcttgttgaagagaaaatcagaagaggttcttttccagttgaatggtcggtgcatttacctagttggtatgatgggttcgggcaaaagtacggtggggaagatcttggctgaagttttgggttattcattcttcgacagtgataaattggtcgaacaagctgttggcatgccttcagttgctcaaattttcaaggttcacagtgaagccttcttcagggataatgagagtagcgtcttgagggatttgtcctcaatgcggcgattagttgttgcaactggaggtggtgctgttatccgaccagttaactggaaaaatatgaagaagggcctatctgtttggttggatgtgccgttggaagctcttgcaaggcgtattgctaaagtggggactgcctcgcgtcctcttctagatcaaccatccggcgatccatacacaatggccttttcgaaactcagcaccctcgcggagcaaaggggcgatgcttatgcaaatgctgatgtcagagtttccctcgaagagatcgcatctaagctgggccatgacgacgtctctaagctgacaccgattgatattgctctcgagtcgctccacaagatcgagagctttgtcgtagaagacaccgccgtcgccgactcacaaacggaatcgcaagctcaaaggatacataccttgtaggatatgaatcctttttgcaccatgtagggcgcggcgcggcccagcgcagctgagttattcgttcgttgtgtcgacaaggaggaagctggagtatctcttttctttgtaagctgtaaaatggcggaataatggagctagctaatacaaagatccttgttggttgaaagaaccctggcttcccccctggcttgatgaaaacaatatgtcaccttccaaaaaaaaaaaaaaaa

SEQ ID NO: 234 - DNA, 746 bp, Glycine max
  misc_feature: Ceres CLONE ID no.651548
  misc_feature: Encodes the peptide given in SEQ ID NO. 126
ataaccgaacaaaattaaagaaaaaaaaaacccactattcaaaaccaaatccaaaaaccaagacacccccattaggtagctaggccttaattgatctccttttctttcaccaccaccaacaacgatgtccatgctcgaaaccgaccaaatcaagcaactgaacgacatattcaagcgcttcgacatggaccaggacggcagcctgacccacctggagctggcggcgctcctccggtccctgggcatcaaacccaccggcgacgaaatctacgccctcctctctaacatggacgaaaacggcaacggctacatcgagttcgacgagctcgtgcatgccatcatgcctgacctcaccgagagcgtcctcatcaaccaggagcagctcctcgaggtcttccggtctttcgaccgtgatggcaacggctacatcacagccagcgagctcgcgggttccatggcgaagatgggccagccactcacctaccgcgagctcgcctccatgatggctgaggccgatagcaacggcgacggcgtcattagcttcaacgagttcgccgccctcatggccaaatccgccgctgaatttctcggcgtcaaggtcgcctagatggctagatcaatacggggctaataatttcgtatgtttgtgtaaccctttttatttttttgtgttttctttagggtacgtgtacgttggtgtaaaggcaaggagatcgaacaaagataaataattaagggatattttg

SEQ ID NO: 235 - DNA, 851 bp, Zea mays
  misc_feature: Ceres CLONE ID no.287120
  misc_feature: Encodes the peptide given in SEQ ID NO. 126
atcatccctgcagttgtggatcagttcgtcctccgtctctctccacaagtctcctctaggcgccaagcaatgacaaggtcagcaccgccggcctctcctccggcgccgaagcccgtgctgcgcgggagccagctggagcagctccgcgagatcttccggcgcttcgacatggacggcgacggcagcctgacgcagctggagctgggggcgctgctgcggtcgctgggcctgcgccccacgggggaggaggcccgcgcgctgctggcggccatggactccaacggcaacggcgcggtggagttcggcgagctggcggccgccatcgcgccgctgctcaccacgcagacgcacctcgtcgaccaggcccagctcctggaggtgttccgcgccttcgaccgcgacggcaacggctacatctccgccgccgagctggcgcgatccatggcgcgcatcggccagccgctcaccttcgaggagctcacgcgcatgatgcgcgacgccgacgccgacggcgacggcgtcatcagcttcaacgagttcgccgccgtcatggccaagtccgcgctcgacttcctcggcgtcgcctgatgccctctgatggaccgatcgatcgatcggtctcgctcaccgcccgccgccgtaaccccgtgtccctgtgaccctgtccctcgcccgccattgattacctgttctctctctctctctctctctcttttgttaggaagatgctcatccggttaatgtaggataactgacacaagataatgtaactcaaaaactcatcgctggtttgtaacatggatgaactcggaaaatgtgtacatattttggatggatttgttcaatcttcc

SEQ ID NO: 236 - DNA, 848 bp, Triticum aestivum
  misc_feature: Ceres CLONE ID no.759217
  misc_feature: Encodes the peptide given in SEQ ID NO. 129
cggtctcaccccaaacccattgtgcatctccatccccacctcctccgatcccatccacccccaccctcaccgccaccaagtcaaagatccaaccttcactccaccaccatgacgaagccatcgccatccccatcgccggcgccggccaagggcgcggggtcgctgcggggcagccagctgaagcagctgcgctccctcttcgaccgcttcgacatggacggcgacggcagcctcacccagctcgagctggcggccctgctccgctccctcggcctgcgccccacgggcgacgagtcgcgggccctcctcctcgccatcgacgccgacggcagcggcaccgtggagttcgacgagctggcgcgggccatcgcgccggtgctcaccgcccacgcgccgcggctcgtcgaccaggcgcagctgctcgaggtcttccgcgccttcgaccgcgacggcaacggctacatctccgccgccgagctcgcgcgttccatggccaagctgggccagccgctcacgttcgaggagctgcggaccatgatgcgggacgcggacgcggatggggacggcgtgattagctttggggagttcgccgccgtcatggccaggtccgcgctcgacttcctcggcgtccccgccgcctgagatgtgagatgatgaccggccgggctccggctggctctgatcggatggactggtagtatgattcttcttctttggtagaactagtcgtagtagggtggttcaaggcccggactggatcaactgtgacgaactcacacggagttgcaacgttgacctggaatgtgtataaattttggtaatttggtcaatcgatgcgtccgctgctg

SEQ ID NO: 237 - DNA, 766 bp, Triticum aestivum
  misc_feature: Ceres CLONE ID no.684584
  misc_feature: Encodes the peptide given in SEQ ID NO. 139
cgaaaagtggaccttttgtactagtacttcagacagacagaagcagaagcaaccagccgaagctcgttcctcgtagacagttggacagtcgtctcgatccatcgtccatcccgtctcgccagcagccgaccatggccgcgcaggcgccgccgccgccgccgccggagcagaagatgatggtggccatcgacgagagcgagtgcagccactacgcgctcgagtgggccctgcgcaacctcgcgccccgccgcctcatcctcttcaccgtccagcccttctcccctctcagctacctccccgtcggctccccgcttggcccgtcggtggcgtcgccggagctcatcaggtcggtgaccgagcaccagcggcagctcgcccaggcgctcgtcgacaaggccaaggccatctgcgccgagcacggggttgatgcagagaccgtcatcgaggtgggtgatcccaaggaaaccatatgcgaagctgcggagaagttgaatgttgatctgctcatcctgggaagccacagccgtgggcctgtacaaaggtttttccttggcagtgtgagcaactactgtagccaccacgcgaagtgcccggttcttgttgtgaagaagaaagaatgaaactccgctatctactgtattcatggacatcgtgtgaagaacccttgagatgtgtatctacatgttgtttgtcacagcatctagttgcatacttgcatatgaataaacatactttgccaatttgaaaacaactatatattcagtct

SEQ ID NO: 238 - DNA, 693 bp, Glycine max
  misc_feature: Ceres CLONE ID no.1059727
  misc_feature: Encodes the peptide given in SEQ ID NO. 142
gatcaaactgtagtcaaactcatctgacgatcgatcgatcgatcatttggaagaaaccatggtggaagagaaaagtgggaagaagcaagtgatggtggcgatcgacgacagcgattgcagcaaacacgctctccgatggacgctctcgtatctcaaagacagcctcgccgattccgatatcatcctcttcaccgcgcagcctcagctcgatctcagctccgtctacgcttcctcttatggcgccgctccgatagagctgataaactcaatgcagcagaactacaaaaacgcagcgttgaatcggattgaggaagggaccaagatttgcgctgagagcggggttaccccaaagaaggtgatggagtttggaaaccctaaagaagcgatatgtgatgctgttgagaagcttggtgttgatttgctaatcgttggtagccatggcaaaggggctctagagaggactttccttggaagtgttagcaattactgtgttaacaaggctaagtgcccagttcttgtggtcaggacaaaggcttgaagagtttgagaaccgcctcgcttgctgtatgtgtgttgtgtaaacatattgataataatgctttgtttgtatactactactgtttggaaaaaaactttgtgaatggaaataaatatattattggtttgataaataacgagctttgctgtgctctt

SEQ ID NO: 239 - DNA, 853 bp, Zea mays
  misc_feature: Ceres CLONE ID no.1272732
  misc_feature: Encodes the peptide given in SEQ ID NO. 143
aaagcggactgctctcctcaattgtcaggcagtagcatccatttgattgttctatcctcttctctgttctcacccccttgcaagcaacaatcgttcaccgatcgatccagtgcgtcctgcatggaaactgccgccgtcgccgcctccagtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgttgagaggcacgccaacgcggtctcggcggcggcggtcgacaaggccaagcgcgtctgcgccgaccacccgcacgtcaaggtggagacgacggtggagagcggggacccgcgggacgtcatctgcgacgcagccaacaagatggccgcggacctgctcgtcatgggcagccatggttacggcttcatccagagggcgttcttgggcagcgtcagcaaccactgcgcgcagaactgcaaatgcccggtcctcattgtcaagaggcccaaggagtagaaggttcctcgcatgtaacgctgcagcttagccaataatgtttcatggcgaccatataggcatatatgtacacacttcacatcccattgcatggcagtgtcttccctagttcaacaactagctttctgctggaataaggtgttcagagttcagacagagtatgtactgtacatactatcttcttgcatttggtactcttgtttagtgaaaagcgttccgtaaaaaaaaaaaaaaa

SEQ ID NO: 240 - DNA, 812 bp, Zea mays
  misc_feature: Ceres CLONE ID no.283925
  misc_feature: Encodes the peptide given in SEQ ID NO. 144
agtagcatccaattgattgttctatcctcttctctgttctcacccccttgcaagcgccaagcaacaatcgttcaccgatcgatccagtgcgtcctgcatggaaactgccgccgtcgccgcctccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacttcggacgtgctggcgagcgtcgagaggcacgccaacgcggtctcggcggcggcggtcgacaaggccaagcgcgtctgcgccgaccatccgcacgtcaaggtggagacgatggtggagagcggggacccgcgggacgtcatctgcgacgcagccaacaagatggccgtgggcagccatggttacggcttcatccaaagggcgttcttgggcagcgtcagcaaccactgcgcgcagaactgcaaatgcccggtcctcattgtcaagaggcccaaggagtagaaggttcctcgcatgtaacgctgcagcttagccaataatgtttcatgggcgaccatataggcatatatgtacacacctcacatcccattgcatggcagtcttcccttccctagttcaacaactagctttctgctggaataaggtgttcagacagagtatgtactgtacatactatcttcttgcatttggtactcttgtttggagagaagcgttccgtaaccttcggttgcct

SEQ ID NO: 241 - DNA, 1002 bp, Glycine max
  misc_feature: Ceres CLONE ID no. 611156
  misc_feature: Encodes the peptide given in SEQ ID NO. 147
attatccagcaaacactatctcaatagtgaagctctaaaccactgccaagtatggtagtttcttcgtgctctttgagctggatttcaccttgcttatcccataagctaaacttgccacatacaaattgtttgcctcgcaacattgcaacttcatcttccaacactgtcttttgtgaattggacacaacccccagcggagaaagtcattgccggagaagaccgctactgttaggcattggagcattaactgcaaatttacaaccaacaaatttggtctttgctcaagaaaaaccagacagataccgagcttttgtggactatgaagatgggtattcttacgtatatcccattgattggaaggaatttgacttcagggctcatgattctgcattcaaagacagatatctacagttacagaatgtacgggtgagatttataccaaccgagaagaaagacatccgagatttgggtcctatggaagaggttatatacgatttggtgaaacatagatacgcagcaccaaaccaaagaccaacaataaatgacatgcaggagaaaaccatagatggaaaacattactatacctttgaatatatacttacatcaccaaattattctagtgcctcctttgcaacaattgctataggaaatggaaggtactacacgttaattgttggagccaatgaaaggcgatggaaaagatttcgagatcagcttaaagtggtagcagactcctttaggcttcttgacatctgaaatgtcacgggacaatgcaaaacatgttttaatttgcctacagatcaagtttgaaatattcgtatatcagagcaaaataagtttttacaagtgaatgatatcttctactataccaatagaactctcttttgtacatcgcatgcaaagtgactttgtctgtcatttgtggtgcaaactcaattcgttgttcctcgtctactcttacattgttccactgctactcctttatggagtatttcggttggg

SEQ ID NO: 242 - DNA, 944 bp, Zea mays
  misc_feature: Ceres CLONE ID no.1551032
  misc_feature: Encodes the peptide given in SEQ ID NO. 152
agtcgcctcgattcgcttccgccccatcctccttcccgacgcctcacatggcaacggccgtgcccgccgcctgcctccgcgcgccgtgctcctctccagcggccgtcgcacgccgacttggggccggtggcccgtcgctgcgcaagcggcattgcgccgtcgcgcccgtcgctgccgcctgcggccccgcgccgccgcggctgcttgacaacgaggaggcggtctgctccgtacggcggcgtgtgctggttgccggtgccgccgcgttcctctcccggcctaatccggcggcattcgcagcagaggctaagaaagggttcctgcccgtcgtcgacaagaaggctggctactctttcctctacccgttcggatgggaggaagtggctgtgcaagggcaagacaaggtgtacaaagatgtgatagagcctctcgagagtgtgagcgtcaactctattccaactagcaaggaggatatccgtgatcttggtcctccggataaggttgccgaggctctgattaaaaaggttttggcaccatcaacacagaagacaaagttaattgaggcgaaagagaatgatgttgatgggagggcttactacacttttgagttcacagctcaggctccaaactacaccagacatgcacttggtgctattgtaattgcaaatggcaaattttacacattgaccactggagcaaacgagaggaggtgggaaaagatgaaggataggctgcatactgttgtggattccttcaaaatcgaaaatagaatatgagtgcctgaattgctgtgttgtttttccttcgttgattcgctttttcttacataactgcagtgctgagatttttcagtagtaaataccgggattgtggattatgctgatcagtttcatttcgaaatgtttgttaccagacttgagcaaaaataaaaaaaaaaaaaaaaa

SEQ ID NO: 243 - DNA, 1395 bp, Triticum aestivum
  misc_feature: Ceres CLONE ID no.703785
  misc_feature: Encodes the peptide given in SEQ ID NO. 161
atctgaatgctagaaggaggtggttggacgatgaggcatcccaacacggtagaaggagttccgcctatcgaagttgagagggccaatttgaaaaaaagaaaaagttgagagggacagagagggaaacatctgggcattctcgttgcagaaagtagagcgctgtacaaacgggccttcacgaaccaagagacatccatcaaatttcatggcgtcctctccacaatcctcctcctctgcacccaaagccgacgacaaggcagcgtcccacaaagaaatctacgaccagctactagaggtcgtgtccacctacccgacggcgcctagcggcatcggccgcccgtacacccaccacccagacggctggtacgcgttcacgccggccgtcgtgaacgccatggtcatcaagcggcacctcaaggcgtgcgacaccgacgtcttcctctccacctttcccaagtccggcaccacctggctcaaggcgctcctgtttgcgaccctccgccgcaccgcggacgggccagcgatcgcggcgctcgcagcccacagcccccaccagctcatccctttcctcgaggtccaggttttcagcaacggccggatcccagacctgagctccctccctgcgccgcggctcctgatgacgcacatcccgtcccggtcgctgccggagtccgtggccgcctccggctgcaaggtggtgtacctgtgccgggaccccaaggactgcttcgtgtcgctctggcacttctggaaccggttcgcgccgtcgccgtgggacctcggtgaggcgctccagcagttctgcgacggcgtctccctgttcgggcctttctgggagcacgtgctgggctactggcgctggcatgtggagaggccggagcaggttctattcctgacctacgaggagctcgccgccgacaccctcggccagctgaagcggctcgctgcgtttctcgggcgcccgttcacgtcagaggagcgggaagccagggtagacagggagatcgtggaggcatgcgccatggagagcctggcgggactggaggtgaaccgctccgggaagacggacatgaccgagtcttcagtggcgaacaacatattcttccggcgcggcgtcgttggcgactggaagaaccacctgacgccggagatggctagaaggatcgatgagatcaccgatagcaagttcagaggatcggggttggcgttgacgccggcaaccgcagatcagaactagtgggttcatgatggcagatgctatataaataaggacgacttgcgcaacatttttataaaatattgtactattaatgtcaggcatgataacttgatcagcaaacatgcgaagggaaataacagaagtgttaccatacagtaatatacatgaatatcgtt

SEQ ID NO: 244 - DNA, 1320 bp, Zea mays
  misc_feature: Ceres CLONE ID no. 1064128
  misc_feature: Encodes the peptide given in SEQ ID NO. 168
atttacgattagcctagcgactcggcatggctactgtcttcccccgtgacgccggcgtctccacgccggaagccgacgaggctaagaaaatctacgatgaagcacggcgagtggtgtccacctacgagactgttcccagtcccagcggaaccctgcaggattactgccgccaccccagcggctggtgcataaccctgccgatcatggtgagctccatggtcgcagagcagcactttgaggcgcgtggcaccgacgtgctccttgttacgatgcccaagtccgggactacctggatcaaggccctcctctatgctgcggcccaccgcactgacgacacatcatcgtccatactccggcagctcgcctcccacaactcccaccagctcgttcctttcctcgaggcccaggtctacaccaaggaccagattccagacctgagctcgcttcccgcgccacggctcttcgccacgcacatcccggctgagtcgctgccaccctccgttgtggcgtccggctgcaaggtggtgtacttgtgccgggaccccaaggactgcttcgtgtctctctggcactttatgaacaagttcaccccatgggacatcgacgaggcacacggccggttctgcgagggtgtctcgttgtatgggccattttgggagcacgtgctgagctactggcgttggcacgtcgaccgaccgggtcaggtgctcttcctgacttacgaggagctcagcgccgacccgctcggccaactgaggcgcctagccgagttcattgggcgccccttcacgccgggggagcaggaggcgggagtggacagggagattgcggaggcatgtgccatgaaaagcatggtcaaccaggaggtgaaccagtccaggacgaccgaaatcgttgagatgccgattcccaacgggatcttcttccggcgaggcgtggtcggagactggaccaactacctcacgccggagatggcaggaaggatcgatgagattaccaagagcaagtttgaaggatccggcctcatgctgccgaaaacaatctcggaaatctcaaagatctagcatccctccgtcgtgtttgatgtttgaaatcgttcaccttttttttctcttgttgtaaactgcaccctgctggcactggcttggctgaataaaaaaagcttgcattgttcttgttgatcaaacgaaataccagctggcgagttgttgatgttacggaaaaggcctgcttagtcttaggtatttttcttatcggtttaattgtgatcaaatgtgtttgtactctgcttaattattaataaaaatgattgtatgcacc

SEQ ID NO: 245 - DNA, 864 bp, Arabidopsis thaliana
  misc_feature: Ceres CLONE ID no. 5367
  misc_feature: Encodes the peptide given in SEQ ID NO. 173
actatcaattcgactggaaaaaggatatttccagattaggtagagagagagcaaaagtactttcattcagacttcagtttaagctatggcggcgaacgattcttcaaatgctattgacatcgacgggaatctcgactccgattcgaatcttaacactgacggtgacgaagcgaccgataatgattcctcgaaggcattggttactatccctgctccagccgtttgtcttttccggttcgccggagatgctgctggtggcgccgttatgggctctatcttcggatatggttcaggattgttcaagaagaaaggcttcaaaggatcatttgcagatgcagggcagtctgctaagacttttgctgttttatctggagtccacagtttggttgtttgccttctgaagcaaatccgaggcaaagatgacgccattaatgttggagtagcagggtgttgcactggtcttgctcttagtttccctggtgctccacaggctcttctacagagttgtctcacgtttggggcattctcttttattcttgagggactcaacaaaagacaaacagctttggcacactcggtctcgttgagacaccaaaccggactgttccaagatcatcatcgtgctttaccactctctcttgctctcccgatccctgaagaaatcaaaggagccttttcttctttctgcaagtccttagctaaaccaaggaagttctaatctcgtcttattattctccctttcttgtgtcttaggctctctctatgtagatgtaaaattttcccgcttttgttgtactttgtgagacatgttttgtgaaaggctttttgcaagagccaatttgaagagaaaaagagttgtgtacg

SEQ ID NO: 246 - DNA, 766 bp, Zea mays
  misc_feature: Ceres CLONE ID no. 1060894
  misc_feature: Encodes the peptide given in SEQ ID NO. 176
aggtagaaagcgaaactctctctccagcttcagaggcttcagctatggcggccgagaatccttcaaacggtgtagacgtcgacacgagtctcgcttccgattcaaacgataaccgcaaagccagtgatttgaccaatcatgactcttccatggcattgacagtcccttccaccgccgtttgtctcggccgtttcgccggagatgcagcaggcggcgccgtcatggggtctatattcggctatggttctggattgtttaagaaaaaagggtttaagggatcatttgcggatgcgggtcagtctgcaaagaattttgcgattttatctggagtgcacagtttggttgtttgccttctgaagaaactgcgagggaaagatgatgccattaacgttggaattgctggatgctgcactggccttgctcttagttacccaggtgcaccacaagcaatgctacaaagctgtgtcacttttggtgccttttctttcatcctcgaaggactcaacaagaggcaaacagctttggctcactctgtctcctcgagacatgatcaaaccagaagtctgaaagatgatttaccactctccttggctctcccaatccatgaagagatcaaaggagctttctcatccttctgcaaatctttaacaaaacccaagaagctcgcgttccctagctcacgttgatcgaagttttttttgtatcctactacttccttttgtagatgttaaaagaacagatgaaaacaagaatcatgtttcaaaac

SEQ ID NO: 247 - DNA, 864 bp, Triticum aestivum
  misc_feature: Ceres CLONE ID no. 639280
  misc_feature: Encodes the peptide given in SEQ ID NO. 177
gaaacaggaaacgataacgaaactcgcagagagggcggacatggcggcgaggagcgagaacgagtcggacggcgacgtgggcaccaaccccgccgaggggggctcgtccctgtccctgccgcctctagctgccggtccagccgtgtgcgtcctccggtccgccggggacttcgccggcggcgccttcgtcggatctatctttggatatggacaaggtttgctatctaagaagggtttgaagggctcactcggcaatgcagggtcttctgccaaaagttttgcagttctttctggcgtccagagtttggttttgtgcttgttgaggaagctgcgtgggaaagatgatatcatcaattccggcattgctggttgttgcacaggtcttgctttgagttttccaggtacaccacaagcgctgcttcagaactgcgccaccttcgcagcattctcatgcatcatggaggggctcaacaagcagcagaccgcgatggcgcacaccctcactgggaacgccttgacctttgcacacgacaatggcgcgggcgtcctccccccttcactctccccccaatcctcgatgcttccgatgctttcgcctcatgctgccaggccttggtcgccaagcctaagaagcactagacagcagcattaggagggagagagtgagatatgctcaggaaacctagctagctcctagcgttatgtaaattttgcttttggataatgtcgaaaatctagattgtttgctttttcagccgggtgttttttgtcgccgcgtttcgtggcgtgggcttgctttgttgatgatatgtcaaggatagattttgtttaccgggaagataagatgtcgtggaaaattttgcc

SEQ ID NO: 248 - DNA, 827 bp, Artificial Sequence
  misc_feature: Ceres CLONE ID no. 29658
  misc_feature: Ceres Seed Line ID no. ME02907
  misc_feature: Encodes the peptide given in SEQ ID NO. 249
  misc_feature: Encodes the peptide given in SEQ ID NO. 250
  misc_feature: Encodes the peptide given in SEQ ID NO. 251
gtaagggatgacgcacaatcccactatccttcgcaagacccttcctctatataaggaagttcatttcatttggagagaacacgggggactctggcctgcagggccatcaccactgcagtggtacctagaacatcctaatcgaaaaattcatctccaaactttcaaaaaaaaacctaaaacaaaaaaaatctctttccttcttctttctccatcaatggcgtcaacaaaacccaccgatcaaatcaaacaactcaaagatatcttcgctcgcttcgacatggacaaggacggaagcttaacgcagctagaactcgccgctcttctgcgttctctcggaatcaaacctcgcggcgatcaaatctctcttctgtaaaaccaaatcgaccgtaacggtaacggatccgtagagttcgacgagctcgtcgtggcgatattgccggatataaacgaagaggtgttgataaatcaagaacagttgatggaggttttccgttcgtttgatcgtgacggtaacggttcaataacggcggcggaacttgctgggtcaatggctaaaatgggacatccgttgacttaccgtgaattaacggaaatgatgacggaagctgattcaaacggtgacggtgttattagttttaatgagttttctcatattatggctaaatcggctgctgattttcttggattaaccgcttcttgatctgttttgttttaattactctctttttttcttctcctgtcaatgcaacttgtgcaattaacaatgtgctaatctttcgtttggtgtgacgtaaaaatttataaaaaaaaaaaaaaaaaaaaaaaaa

SEQ ID NO: 249 - protein, 73 aa, Artificial Sequence
  misc_feature: Ceres CLONE ID no. 29658
  misc_feature: Ceres Seed Line ID no. ME02907
  misc_feature: Peptide encoded by SEQ ID NO. 248
  misc_feature: Phenotype: ROSETTE LEAVES Useful for making ornamental plants with modified leaves
MEVFRSFDRDGNGSITAAELAGSMAKMGHPLTYRELTEMMTEADSNGDGVISFNEFSHIMAKSAADFLGLTAS

SEQ ID NO: 250 - protein, 121 aa, Artificial Sequence
  misc_feature: Ceres CLONE ID no. 29658
  misc_feature: Ceres Seed Line ID no. ME02907
  misc_feature: Peptide encoded by SEQ ID NO. 248
  misc_feature: Phenotype: ROSETTE LEAVES Useful for making ornamental plants with modified leaves
MTHNPTILRKTLPLYKEVHFIWREHGGLWPAGPSPLQWYLEHPNRKIHLQTFKKKPKTKKISFLLLSPSMASTKPTDQIKQLKDIFARFDMDKDGSLTQLELAALLRSLGIKPRGDQISLL

SEQ ID NO: 251 - protein, 52 aa, Artificial Sequence
  misc_feature: Ceres CLONE ID no. 29658
  misc_feature: Ceres Seed Line ID no. ME02907
  misc_feature: Peptide encoded by SEQ ID NO. 248
  misc_feature: Phenotype: ROSETTE LEAVES Useful for making ornamental plants with modified leaves
MASTKPTDQIKQLKDIFARFDMDKDGSLTQLELAALLRSLGIKPRGDQISLL

SEQ ID NO: 252 - protein, 498 aa, Zea mays
  misc_feature: Ceres Clone ID no. 375578
  misc_feature: Full Length Peptide Sequence for Ceres CLONE ID no. 375578
MGKRGKWFSAVKKVFSSSDPDGKEAKAQKADKSKSKRRWPFGKSKHSEPSISTVPGTAPAVAPLPSPPATQPHSLEIKDVNPVETDSEQNKHAYSVALASAVAAEAAAVAAQAAAEVVRLTAVTTAAPKMPVSSREELAATKIQTAFRGYLARRALRALRGLVRLKSLVDGNAVKRQTAHTLQCTQAMTRVQTQIYSRRVKLEEEKQALQRQLQLKHQRELEKMKIDEDWDHSHQSKEQIEANLMMKQEAALRRERALAYAFSHQWRNSGRTITPTFTEPGNPNWGWSWMERWMTARPWESRLAAASDKDPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 253 - DNA, 1836 bp, Oryza sativa
  misc_feature: Ceres Promoter p530c10
gcctctcgaccacgagtttagcacttgtgcaacatatatgcgtgcgatgaacatctactgatgcgccatgcgaattttagcgttcgttcatgacgcttccaacggcacagaggctgagcagcagcatgcatgcatggctcttgtgaaaacaaaaaaggttactggtaaatgacatgctgctgtagctagctagcagaatgcaaggcccatgcatatgcaatgctatgcgacaagtacagtaccagcatgtatggtagccagctaactaatctatcagcagaggcagcaagctcgtgcatggtgtgatgcacttctctccagtaatctagtggtaattttcacccaaagcgttgctcatatggacagtaattagtaatattaccaaggttcacaatcccgttacctgaccaaatactactcacgaatggtatctctggttttcgttaaaaccgttggtaaaccagcaaaaatagacaaaatttgtcaaaattttaaattttagttttttttttttaacttagccgggaaaccttgaagtttgtgctgtcgagctgtcctgggaaggacggttttggttgggattgtgaaccctggttactgcacttcatttttgaacagatattagtgcaacagacaaatgccaacgcatttttttctgtttaccggcaagctgaagcttttacgatccccatacagccgttgctgcaaacctgccaagaaagagcagcagaaacaggtgtcattttgtggtggaaagccaagtaaagtaaacagaagatggaagatagtgaggaccagggagtgaggcaggggacacatggcccacgcctccctgcacattttcgtgtataaatacaggtggatgcatcgctctcccagcatccatcggttctctgctctgttcatccatagagtttcctcctcttctcctttagtgcaaggtagagaagagcatgtgtgtgtgtgtgtgtgtgtgaactgtgaagtgcagagtgcttctgtagttctgtgttatgtccatagtgatcttgttaggattgttgctatggatgcatgatgttatggttgatctctgaattacagtagggacttttctgagatctctggattagtggggggtgctaaatttttttctggttgcatcagcttgggtttctggtattggtgtgggttcttgctctgaattttggttcagaatgtcgatttgtttgtgtttgttctctgaagttgagagtagctatgatccatccagcacagaactgcaggtcctgcctgccggctgcatatacaggacatgccattttgcaagctctgggcttatggtttctcttttggagttcttcttcttgcatgatctgtgttctctaacaaaggaagcaagatttagcaactttattcagagacaagaaaaggatctggcaaccttttgtttctgttttatcctactcgtaaagattgttatttaagcaaaaatttcccaaaagttttaaatataatttccatgatgtgccactctcatgtccttgaacctggcactcattatgggctcctcagaagtgctgtagctaatgtcactaatcttttgtatctttgttcatagtcttgtattttatgatgcttatccctttgtgctttccatgtttgatgtccaaatgtcatggcaatgtttttgacttctagtaggggttttagtacctttttgttagataagtacatccaaattctgtttatttattcaaaaatcattctgtttattcactgaaaacatttgtccattcaatggactcataaactgtctgtgtttttcaggcttgaggatccatctagaagatagca

SEQ ID NO: 254 - DNA, 3000 bp, Oryza sativa
  misc_feature: Ceres Promoter pOsFIE2-2
gcttaacacatgaactaccaaaatatactgatcactttgttctagtcatacataccttaagtcattttattctgcagtgtttggattggagggagcattctagcatcccttgggtcgttccagcaaatgtggttctccaaagcagagtaagcacaacacagtattttaggttatgtttcccctatctcgtcacggacagctcacaagttaatgtgatttatctcactatagatacgaagaacatggagtatcctacatccaaaggaagtgcccatgaagttgtggagcatcgctacgatttgtgaccaaatttgggtgcatgtgggcaatcgtattacagccaccctgttgttgatctatatcgactattatccgacgatatttatcattatattatgactagttagtttgtagattttgagagggcaacataagaagcaatccagcttaacctgttatgttcttgatggtagattctagttcatgtgttgaatctgttctccctgctgtagaatgtatcgagttgctgctctctactctgtacttttagaataccttttcaatcatttggagtcagctgattgttgtactacttatacgccacctgattagtcatgtcaacaattaaacttgagcactggttaagttaagagtggcctgattgtagttgataatcacattttattcgtagacattgtatgctggatctttatcagccaccgtcagatcatcctctgtaataaatcttcatcagacgtgtgtgccaatcgcaaggaacacgaaatgcatccgaaatgttactctgagttaatcaatactataattcttggtcaaattaattatttatatctataaagtttaaattaaatttaggaaaatgaattcatgcaaatcttgtggtaagttgtcaatttcataaaaaatccagcttactactccctttttaggagtgtgttgtggctgcacacttctgccttttgatatatacggttctattctcggtgtactcctttattattattaaaacaatcccagttacttggtaagtgctaatcacgaatcaaagtcaacataacaaatcatgtgcgtacagctataactcgattacacaaacaacaaaattcatatttgaacataaatccagttgtagcatatctggtagtataaagttttttttttgtatagaagagttttaatttctgtaagttttggaaagcatttaatcctagaaattgtagtgtagctcaactaaaaaataaatgaacttgaatcgaaattgggttgtatcataaatctttaccactcaaacgaatatttatcctaaaccacaaatgactcttttcatcaaggaatgttttgttttcagcattttaaaaaaaaacttttctaatatggttttcatgtttcgttcttttgaaatttaacatctatttaatttgcacggctccataaattcaacggatacatattctgaataattactaaggaggcatatatcggctctcttaatacaaccgcttgtttctcaaaatttattttgagttttgtctacacattctcaaggacggtacaaacacactatagatgttcacaattttttttttctaaagttgattgatggacaaatgtttgaacatataaacatataagcactgaatatttgcttatgcaggaggtatttatatcaagttcgatactttactaccatagtccctaggacactaaaatgccttcaatgatctgatgaagcctaagagagaatattgatcagtggagcgacttgcaactacacatggcacaagtagactagacacggtatatattcatattaacttgttaaaattttactacttaacagttcacttgtggtgcatccatatcaattcttacttacacaatatttgtaaaaacaacctaacactataggatgacctagacaacctttatgtcaatcacacttagaagatgatcgtctttttaataaataatgtgtactacacaccatgctctccatatagatcaagatctacaaacccttccacttataaaccttaccaccaaaaactcattaagttgcttcatttatctatgctattaagaaaaaaacttatttcgtttatgccatttctagaaatggctagtcacactattcacaatattatataataaataaaagtttcaaatattcatccaccaaaaatcatcaagtcgtgggacttatatgttaattagagaagtccctttgggtgcaatcgattttggaaaccctaaattttttctatacatagaagagagagatgtctagttgcaattgcttttgcgatgtgccaaccacccttctagctttcatccacgtctacttaattgccattcttcttcttctttttcttcactattactacctcctatcttagcgaatcttcttcttcttcactattactacctcccaccttagtgaattcatcctcattgttcacaatgacattgctaagttaactaggtatgctaagtacacaattagaatataacctagagcctttgtttccatcatacttaaaagatgacatttttatatagataaagtgtgctactcacaaggcttactatatatatgtatgatacacacaaactccacaacccaaaactctttcaagttgtgtggcccatctatgctattaaaaagcccatttagcccatccaacatgagaaaccctagggttttttccctataaaagatacctaggttattgttgcttttccaccccgcccgccgccgctccctattcctatttaatcccatctctcttcctcatcaccgctctcctctctccaggcaagaggtacgcactttttgtttcggatttgaaatctttgcttcgttttactatcattggtcataagttcttttttgaagatgtttgagaataagtttatcattgagattatcgtcacttgtgataggaagtacgcaacctcaagccggacaagacgtgagcaaag

SEQ ID NO: 255 - DNA, 2023 bp, Oryza sativa
  misc_feature: Ceres Promoter pOsMEA
gagagcagaacatagtagccgctgttttctgggggtgcaatttgtgcaagatcgctatccttatggaccatgcaagcaccaagcaatattaagccaggtccaacagcggtcttggggaattcagaaatgagcttaaaaacctccttgagctggccagctcagccaaggaggtccatcatgcatgtgcatgctcaatacttggaattattgcaaaatgatcggtcattgactggaagactttgcgcccttcctcagccaaccttatgtggctgcatgcatagagtaccaacaggaaggtagcgtttgttggaataaggtttgcatccagcatgtccttgtagagcttcaaagcctcagcaccttggcccatgaaggccatatccagctaattgcattccatgagaccacattcttgctatccatactgttgaagtgaagatgctccgagcttcggaaatgcttccacactatgcatacatgtcaatgagcactgtcatgacataaacattgggccccaagtcctcctcagcgataatcctatgcagccactttcccagggacaaagctccaagctgtgcacacgctgaaagagagctagaaatgatgattggatttggtcacacgctaagtaccagcatttgctcaaagagggcaattgccatctccgtccagccattctaggcataccctggtattattgctttccatgattccgattccgtggtcttctatggcatcgcattgaaggccttccttgcagactccatatcatttaacctacagtacaatatggtaattgctgtcgacactggagaattcgcagtaaatccagacttgagaggaccatgtaagcattgatcaagcagttcattcccaaacagactatacgggatcagtgccagtgctcgagtttggcttcaattccaaggccatcaacccaataaacagattaactgatgaaccaaccatgcaattcgccgagcaaacatagattaagcattgtaggcaaccaaatctggattctccatcaagtcaaagagacgccatgcagaattccacatccccgctgtatacaccgagatcaaccggtcagaacatgctcatactccgccaaccctctcttcagaacatgctcatactccgccaaccctctcttctctgcaagaggcatcctccccaattccccattgttatatctgttgctggtaagaccgttgccagcgtggttgtgtcagaccgaacagactctgcactcgccatcctcacgaacgactccagggcctccgaaccaggaagcccggccggccatcagcgtgttccacataacggtatccggcgactgcacagtgtcgaacaccttgcgtgcgtggtcacctctggacagcatgaagcgtacaggctacagcttggccaatgcggacgccacgaacgtgtcggcggcgtaacccgcgcgtgcagcgcgccgcgcgcgggctgcggagtcggttggagacgacacgccgccgccatgagagcaatgagcgaggtggcggcgaaggcgaaggagaagtagtcgaggcaagcggaagagaaggcggcagcggagaaagcgatcggggcggcggaggaggtgggtgggagggagggacgcgtagcggaggtcggaggaggagggagctgaggtttccggggcgggggtcgagagggtagtgtacggaggcgagggacacggcgaggatctggtcgaggtagcgcagtgtgaaggaaagcgcgatgaggcggagggcgccggcgaagagcggcgcggcggatagcgggaggaggcggcgccggcggggtctcatccgattggaaacagattgggaagggggagggggtaggaatacgtggcgtcggcagtattaggtagagagagaaaccctttccatcctttgtctcttagccccgaaggagagagaaaaatcagaaaaaaaaaaccctccgcgtgtgggggaagcagagctccggacgctggcgccgctcgcgccaccgcacccgcaccgcc

SEQ ID NO: 256 - DNA, 2034 bp, Oryza sativa
  misc_feature: Ceres Promoter pOsYp102
gaacgacccaaacgcgtaaatggtggtactggtttccctgctttgccgagtaccagcagccacgaagaacgttacacaatcgagtacaaaatctataagagcaagtttaatagcatagccaaatactacctctaaatcatctatagccaatttaatagttcatttattcaataattacttataaacatatactacaatcattaatatatggtcttacttcttatacacataatattttggagtccgtgttacagctggctataaatataagggattttggttggatgtggtacatcctattataatgaatctagacatgaaacctgtccaaattcatcgtgctaggatacgccacatctaaccaaaatctcttatctttagggatggagagagtaataattaaatgaagctaggtagagtttcccggtcaatacgcttgcgtgtgcttataagagcatggccaacagtttcccgatactcttcccaatatcagttttgaggagttttgttggaaaaaatcgctccaacagtagacctaaatcacccctaaaagcttggcgtttccaaacccgcatatttcgttctccacttgtagggaagagactcggcgcccaatccttcaaccgcatgcacttcgcgcgcgctgtgtgaaaattttcctaccaggttcttctttgtgcgttcgtctacctgtgagtcaatccatcacgccagcagcctcatcttccccgcagctgtctgggaaagcagccatggctcccccaagcttccccagcgtcgacatttttttctcagcggcagcgccagacccatctccaacccaattgggcggaccttcgtcggcgctcccccagcaccaccaccgactcgaatcggccgtcgcccctattcatctccaatcgtccctcgaccctaccgcatcctgcagcacagcctgtctctcgcgtcagactggcgctgcgctccccccggtaatgtgcaggcgacaaaggccccatgcgatgcgaccagcagccggcgacaaccggaggtgcccagtcgctggccttcatcgaatcatcgtgcacctcggtcggagtcgatttctgattgttgctgctgctcaaatctggagcttgctattgctgagaactgcttggtggtggtactggaaatttgttgtttgctggctgatgaaaactgttgttctttgctgctaaaaactgctgcttgctagtactgaaaagtactattgcagctgctgaaatatcttgctgcttgctgctgaaaacttcaagttgttaacaccgttcacactaaaaaagctgaaattttttttctgggctgaaaaccccattgttgatgattgcagaaccaatatttttccatgtaaaatacaggagatcgtggtaataatcaagtgaaatatcattttggggcaaatactcagatcgtacctgaagccaatggaaacattgttcaatgcttaaactgtcagttatgatgtcaaagagattgatcactgaatgtcctgaaaggagccgtgaggaggatgcagcattgcagcgtgcgcgagcgtgagtggaggagaggaatgacgattctgttggtagttgtcgatgtggcctactttttttgttttgaggattaaattttgggaatctcttggagataaaaggtattctcataccttaaatcctttttagagatctaaaaaaaatgatttaggggattgaattttgggtggctgttggtgatgctctaagttgcacatcctggggaaaaacctccctaatccatcagcaaaccgatcaaccacccacgacaagtcgacgccaccgttttttttttctccctcctaagtcctaaccccacaaaaatcccgcgaactttcgtctcaccacgcgccgcgtgccccctacaaataccaaacaacacccaccacgtccactcacaaaccacgcaggaaacctcagaaaatcaccgtacgcgacgcgggcccaagaaaaccccgacagaaaccgcgcagcagcaacaccaccaccggcgtcggag

SEQ ID NO: 257 - DNA, 1877 bp, Oryza sativa
  misc_feature: Ceres Promoter pOsYp285
ggcccgagttaaacgatcttccacgtgtcagcgaatcctagtcgttcgatgaatctgaatctgacttgtggtggttggacggccacgtgttaaaaaagggaaacgtccgcatcacccgatgctgggacatttgcaatttcgatccagctgtagattgaccagttgttactctcttttttttaacaccatacaaacgtaatactccctctgtcccaaaatataagtattttttttaacctcggttcagtcttcgaggtgctactttgaccaataatatttataaaaataagatgttttaaataaagagagttgcatattatgatagctcgtttaatgataaacaaagtaccatcaaatttacatgattaatctttttaatttatttgctattaatagttaaaatttaaaaagtttgacttcacactgttctaaaaatacttatattttgggacggagggagtacacattagagcaggtacaatagcagactagtagccagctataaacatattttaatgagataaaagatgagagagaacagcgggctacagatctgtagccagctgcagcacggactccaagacattgtgtgtgtatgacaggtgggaccatatattaatagtacagtaagtaactattgtatgaattggctattagattagctataggtgaattgtagctagtagtgggctatactattgaacttactcttatatctctcaatatctccagaaaactaggacgatatatattgatattaacaaagtcatcatagatatctcgctatcgacatatatattacctatcactgaaaaaataattaatcataaatgcaagcacatatactacgttcaacactgaatgtaggtagattggtagacgggttccaccgcaagaaaagcattgcaccagtgaagaaagaaacatcggaatttgtatgtagtttgttgtttgatgaattcttttgattaaaaaaaactaaaatcagagttgattcagttaatggtgttgcctacgatatacttccatatcatgatatcactgtagactatgaatcatatctttaattaaaactaaatcaagaaattaagtatgagacctcaactcaatgaagaatttctagttgaaaaacattcctagtgtgcgttcggatggaggtagggatcttctctccgttcatataaaaccggatggttcattagaacatgattaattaagcaacagttaatctaaaaataaattaatattttttaagaaatttttgtatagagatcttttgaaaaaaatacattggttagaaagcatactaataaaaagagaaaaataagaacatagtactatagtagaaaatgagaacttggagtatttgagaggatgggaaataagaagattaagaagatgcgtaaagtgaacggttaacgcatgattgattaattaaatattaattattttaaatttggaaaataaattagtatgatttttaagcaacatatatatatatatatatatatatatagaaaaacatagttttagaaaatataagcgtgtaaaacgatatgcaggaacgaaacgttgagcattcaaaatttcaaattgaacatatgaatcaagagagaataaaaaaagaggccttctaggctggcatggacaattggacatgttttcaactagggtttcaagcttcgagcatccacttttgtccttgcaaactttatacggcaaggcccgtgaatctagccccccacaccaccccacccgcccgcgccgcgcggccgcctcgcctcccctcccttctcctcctctccgcccccgccgccaggccgtccacctccgccgtctcctcccccattcgcacccaaggcgctggcgcggaaggc

SEQ ID NO: 258 - DNA, 1000 bp, Arabidopsis thaliana
  misc_feature: Ceres Promoter PT0565
caccaaatatagtgttatttcaatactaaaatggtgttatggttggagatgccctaaagataaacatgacgagacacgagatttattaatttcttgatcaaccataacttaataacttaatattaatttcacttaataatttccaattaagtgaatctttacttcaccaaaagttcctaacgaactcttattttctagcatcaatattaccatgaactagcatcaatactatcatgaaaaattcctacttcctatccaactcttaataacaatgctagtcttaacaatattcatcaaaaacttgatatagaccttctaacttagccacgactagtatcggtgaataccaaaattaatgtattcatgagaacttgagatttctctaatgtattcttgttactaaacaagtaacaacactcaagaaatatcatgatcaaatattttactcataaactccatatttcacattttgaaaattttaaacagcaaatcacattgaattttcgtggtaaaagtatttaaaattgaaaaatagcagctcctgatttcaatgtataaatttatctttatatggtttatgtctccaacttattttaaaaaagagagaaagagcacccaaaaggtgaccgtttgaaattcgaatttatttccgtttgaaattcgaattcaaaaaaagtaaaccgaaccgagtctcgttactgactgtcacacattgtttccctaaaagctaattaacccatacgtggcgtaatataacaggtcagtgatcaatactaaataacagacatacacctttaaaattcgtgcacgctccaaaacaaaatctacacttcaaaatcaacggtcacgatcattcctcaaatttcaaaaaattatttaacctcacttccttcgctttgtttttaaaacctctctctctttctctttctctttcgccattaaaactctgtttcctttttcagagattctcagagaagattcattttaccctaagaaaaaa

SEQ ID NO: 259 - DNA, 999 bp, Arabidopsis thaliana
  misc_feature: Ceres Promoter YP0015
ttgagccttattgttgttattgacttttagccaatagaaagagatggaaattcaataattatccacaaaattccaaatcattggtgtacaaaaagatctaaggctgttatattttcaaaaaagaaagaaaagaaatgcaacaaatatggattaaactgtggtttgtaaattgagctttgcatgaaaactttatcactatgatttcactactccatatttattgactaaagtggcactaatgaatttcttaatcatgaaatcttgtatcaaaaagtactaaaataaacatgacattggcaattaggaaaattctaaattagaaattagtaaaaatgaaaggtgaaagggaaagatgatgatatgaattggttggtgaccaggagaaatgtatcccgatttttgcagacactttcagtgtccccattcatataattatggcccacctcgttaagatttttcattcaccaccataacaagatctaagcttagatttcatgtaattaaacatataatatacttgccaatactatctaataaagtatacttaagcaaaaattattactctagtgtaaggcgatgaaatataagtttagttgaaaatttatgtcgatataacaaagtataatgaattaagaccttggttttcgattaacaaactaattaaacactagttttgcctaataaaaccgggaatcgtattcaaaaccgaacgacaaaacaagggacaagttgagagacaaaaccaaatcagcatctttcttccagaaatgtcatgaccacatgacgtcatcttgacccttcttcattgtgatatctgtggataaagcgcacgtgtttaattcacgaaccttcgtagtaacgaaaaatccacaactttcatattttttaattacccactaaactaaaacaaatttggaaaaacatgaaaaactttttctttttttccaggttcgtgaacctcgtaccctctatataaacctcttaaccaccttccacata

SEQ ID NO: 260 - DNA, 999 bp, Arabidopsis thaliana
  misc_feature: Ceres Promoter YP0087
tgaattgagtaaaatgtgttttcaaacagttaggtggtagaaggtaaaggtaataacatcatgatcttactaaaagaattgttgcatactaactatcaatattctcaacaacataatataatgtttttttaggtaattttccattttaattttttgtgattaaacaattaaacaactcgaatgatgatgataaaaaaaaaaaattaacaactcgaataagttaaagtagcaatacacatgtcgttcaattcaaccaataaagtaagacttatatttttaagaagttgactaatagcttaataagttggaaaacttgtgtagtttcttaattcccacgtgcagtaagaaataaaaatgaaaaaaattattatatccttcccactctgcgacttttcttttattttatcaaatattaaaaagattcatatcacagtttacacattgaaatcataaacgataattatgtattttgtaataaaaagttagttctgaagctcatactttggatagtcgctagtcgctaatatgctccttgtaataattaaagtcactacgacgcacgtcaaagccgatatttagggcttaattgatgcgtgtttttcttttcatataatagtaatataaattagtactaataaagtatgatggatggttgagacagaaaagaaaaaagatgactgtatggtcatcattacaaagaagaatgtattcttcatgttcttaagaataataaaatgtcacttgtaaatcaagttggtaagcattttgagaactttgttcgatgcaacgtatgatgatttatgtagacaaaagataaaaccgtatcttcaactattgccaagaaaagataaaacctaatctagtcagtctctcaacataaatacaacccaatagccaaactgtgtccaattcggagagaaactaaactaaaacaaaacacaaaagcccaacataagcccaataaaacccattttataaacagaacattactaacactca

SEQ ID NO: 261 - DNA, 1000 bp, Arabidopsis thaliana
  misc_feature: Ceres Promoter YP0093
atgatgaacattctacatatataattattatgtttaagcacttagacagcataaattctttctaattatataaatctaaccttgttacattgtacatctataaattacttgaagaaataacgagttctatttctttttaaaaattaaaaatactataccatatctcagtgattaagttgaaccaaaaggtacggaggagaaacaagcatttgattcttccttattttattttattcatctctcactaatgatggtggagaaaaaaagaaaatacctaacaaacaaatatatattgtcatacaaaaatatttctatatttttagttaattagtttatattcctcacttttcagggcttatataagaaagtgagcaaacacaaatcaaaatgcagcagcaaatactatcatcacccatctccttagttctattttataattcctcttctttttgttcatagctttgtaattatagtcttatttctctttaaggctcaataagaggaggtactattactacacttctctctacttttacttgtattttagcattaaaatcctaaaatccgttttaaattcaaaaataaacttagagatgtttaatctcgattcggtttttcggctttaggagaataattatatgaaattagtatggatatctttactagtttccattcaaatgattctgatttcaatctaatactctcactctttaattaaactatatgtagtgtaatttcacactgttaaatttctaccatgtcatgtatattagagttgcatagaaaattgtaaaacatccatttgaattcgaatgaaacaaaatgttttaaaataaaattttggtttttaaaagaaaaatctaaaactgaattatatcgtttaaccaagttgtaaaagtcataaaacgtagtatcttgtaaatcgctcttccacggtccaaatagacttctagtaataaacaagtaaaactaattttggtttcttactaattttcacaga

SEQ ID NO: 262 - DNA, 999 bp, Arabidopsis thaliana
  misc_feature: Ceres Promoter YP0108
ttagctgaaccaggaaattgatctcttataccagtttccgggtttagattggtttgatggcgatttgattaaacccccgaaattttatgtcgtagttgtgcatagtattattattctttgcggacaatagacgtatcgggaccaagttctgtagcaaaattgtataagcttaagtttgatgaaatttaaaggtaatcactaaaacccaaatgggacaataaaccggtgaagatttagagtttttaattttgactcatgaatctggagaaagagccctcgttaaaaggagtgaatcaatccataggggaaaaagttttgtctttttaaaaactaaagaaccaaaccttaatagaagcagctcaatgtgtgacaactttccactggcactaagataaagtgactagcgatgagtgcaattattgaaatagtagatggtaaatattacatacaagagtaaaaatatctttatgtcaatgcttaattcagtgtttctggttaacaagagaaacttctctaactttcgtaattgggtcttataaaattttatgcaattatgattttacccttttactacttttcattagctttcacgaatctattttgacaagagaaatcattagaggtaaacatgctttttggtcaagggccttaacagttccaccaatcaagctcaaaagttgtacttaaccgacatcttctgtgaaaacatataattacatgtacaaatcaaaactaccttatgaaataaatagaaatattgcagttcatttctaatttaacctcttcaacttttaaaactatttacatttctttatgtcatttctagtcattttgatgcaaattgtaccatttatggattatcttcacaaatttttaagttggtgaaaactttttggtgggtagttaaaacttgaaatagaaatttactttaccaaaataaactaatgaaaagtaatcactccactccctataataagatttccaacgttcccactaagc

SEQ ID NO: 263 - DNA, 999 bp, Arabidopsis thaliana
  misc_feature: Ceres Promoter YP0022
tagttccattacaatttccaaatgatttgttacaaagctacaagattattcgaaataggatttcatccataagagagaatggtgtggtcgacgctacaatgttgatttattggttgtggtttgcatcttggggatgtcaaatcctaagtttcaagttcttgtaaaaacgttttcaggtttctttaatatattttaatattaatgtaaaaagaaaagatatagcttttgtacaaaaaaatttgtttaatcactatgtaggaggatgcgatcaaattcatggaatgatgtattattagcttttctatcctcactctaaaaacaatactatagtgagttaaataatttgatcatttcaatgtagattaaaattttattaaaagaagaaaaatttaaaagcctataacaaaataaaaaaggaggctcgaggtatgatgggtgtagcagaagagctggcaacagctatcgactgagtgattacgaactcagtactcagtgttctcagctcacacactctttttttgttctctttcttttggacagctttcattttctcttttcttttttctattttgtttcaaaattccatccatattaaaataggcctgatcatgagaataaaggaaatactaatgatgagtttctcaataatgcaataagatgcaattattatgagctatttactattgaaaatgagcaaataaatgtcaaaacacaatctggttaagttagagcaactccattgtataggattcatgtagtttctaagaaaacaaaatgtattaatattttacttttacatccaaaaaaccaacttatatgagtaatagaaacgatcctaatattaggaattttagagattttctctcatctgtttcttaacttttcaatatttttattttttaaaattgtatgagtttctactaagaaactactgctggagttggtcttagcttcccaatgcttctccacctatatatatgcatatctccttcttaaaac

SEQ ID NO: 264 - DNA, 999 bp, Arabidopsis thaliana
  misc_feature: Ceres Promoter YP0080
aagcggcaatttagtaagaagtactcaaagtatcatttaccaaaagtatatggttttgggaagagttgttagggatgtattctttctaaacagatgatatgacgatgttcttgaaaactaatgttaaagacggaatctctggcatcttcactcgggagatatattaaaccgttgattgtagttagccatgtacttagcttagtgcacaaataatctgctgcaagaaatctttttctattataatatctctcatttaaacattagaacatattgtttaacttgttcttctagaaataaaactgctaatttcttatggtaaactattttcctttagattgcacaatcgaactcgaaaatctagtggagactatgtgactatgtttatatatatgaaacctaaatcaaattatcccaataattgggagacacaaaagaaaaattacgaaagaaaacaggaaatcaaatcaaaagataaagagaaggtaaaaaaaggcaagaagcactaatgtttaatatttatagttttctccattaaagaaaaagcgatgatgtgtgttctcatcttttgtgaaagtatatatattgcttttgcttttctcaaaagcaaaagactcatccaacaagaacaaaaaaaaaaactaaagctcaatccaaaagacgaagaatgcattggatactacaacttctttttcacttttctttcaaatttacaattatgattttcacaatacagtttattcaaaaataaataaaaaaacgaggcatgaaaataatgattatcctcttcacttattaagccactcactataagcagagcaactccagaacatagtgagcccccaaaacattaaagcatgatgatgtctaatgatgatgatcttcttcgttccatttctctaaatttttgggatttctgcgaagacccttcttctctttctcttctctgaacttcaagattcgtgtcggacaaatttttgtttttatttttctgatgttaca

SEQ ID NO: 265 - DNA, 3000 bp, Arabidopsis thaliana
  misc_feature: Ceres Promoter PR0924
atctataacgagttaacatgttgccagtttgaatcaagaagcttggatgatgaatgaatggatcggtttgtggtacaattcttaaaattgtagtagaggagacagagaaaaaacatgataagactttggtatttacaacttgacggagacaagacagtaagccaaatctgtcacaaaaacactcaaactcttttctcagtgttttgagtttaaagagagacttattcacttcccctttcgtaacacttatttgtctcccaaccaaacagtttctgtcctttcccttgtcctcccacgtgcatctttatatctcatgacttttcgtttctagatcttgaataatgtcttagtggattaggtttgttgtcggtaaattaggtgaccgtttttttcttatatttggaagatcgcgggatgaagcagatactgagtttcagggcatacacacctaatttgaaaatcattgttagtccaatttcactttaatcttgtttacaaaaaaattgatctgaaaatgttgatgggataagtaaaaatgtaagttttgctagtagtcatgatataataatagcaaaaccagatcaattttgagcaaaaggaagaaacaaaaaacagatcgatcccacgagcaagactaagtgtaaagtggttcccacaagagccatatggatatggtccttcaacttttaaagcccattacttcagtggtcgacccgacattacgccacgagtagtcacgcacgcacgactccgttcacgtgacattcacgttgatatttccccctctactctcttctgcttggttgatctaaaaaacatgaagagaccaacctaatttcatattaatatatgatatagacttcatactcaacagtcactttcgtaatccaaatccatatcttacgaaattagttcttaataaaggttgtggattaagttataatattgtgttaagagttaagacacagcatataaccttgtaccaacagtgctttattcttaaatggaaacaaaacatatgtcaatgtcaagcatacagctaaaatatcattatctaatattaagagtaaaacaagataattaaaaattgaaacaacaccatatttttatagctttacttatcgtatttttctagtcttcatggtaattgtgttgctttattttgtttataaatgaatttggttcgaccagatagtctaatatcagtttttaaacactggttttaataaaatcatatgtcggcaattcaacctgttacgttgtatgattgtatcctagtcaaataggggaggaggtactagtcgtttcaattagtttacgtaatcaatccaaagaaactataagctataaagatcctcaatttgttggttacaataaaaacaacagttgtcaaaatttatgtttataaaaagtaataactatgttccttcccatatagagcaaagtacctcaggataggcaaaccgtacttaatagcccttattcataatttgatccaactcttccccacaaaattgcaactgatgaagtcaatacttgtatagtgagtcaagctataaatgtctagtgatagttttgtctcttaaaaggttaacaaaagttatgacaagctgaaaaatcagagtttgctaggagtattacttacagttatcagtttaagtatcacatttatagtattgtatacaatgattcttaaattccaccttttccgtgcgaaaccaaattttctattggaaacatagaatgtaaacaaaaatatgggacgttgtccgttccaacattaaccaaacttgtctattactaatattcgtgttggtttgatgttggatgtctaaattcgttgaatcatgtgtctcttgacgaaatatgcatcttcttatttcttagtatagatgcactttatcattcttttagtacatgcttaatttttttttttaaaatatgttgattgtcatattgccaaaagtatgaattaaagacgcacatctaacacaagttagcagccgtaaatccttccataaatttattttgcaagttttgctcattatataatgagcggaatttatgatataatcgtttgtaataatgttatgttttgatcaaaatttgaaattaaaagtaggtgagaacttgttatacagtgtagataaggtggatcttgaatataaaaataaaatttataagatgtatttaaagcagaaaagcataaaactttagataaaataatgtaaaaatgtgttagcatcaatgttgggatattggccgacccgaacttaatcaatgtcggaagccattacttctctcccaaaagacctttttccttcggagaactaggaacttcctcactacctttcgcttaacgtgaaagccataaatttcatatattcataaaaatcagaaaatctaaaactgtttagtatcacctgtttttggtatagactattggttttgtgttacttcctaaactatatgatttcgtacttcattggatcttatagagatgaatattcgtaaaaagataagttatctggtgaaacgttacttcagtcatgttgggtctagatttacatactactatgaaacattttaagataataattatcctagccaactatatgttctatattatgggccaagaagatatagaactaaaagttcagaatttaacgatataaattactagtatattctaatacttgaatgattactgttttagttgtttagaataaatagtagcgtgttggttaagataccatctatccacatctatatttgtgtgggttacataaaatgtacataatattatatacatatatatgtatatttttgataaagccatatattactccttgacctctgcccccatttccttttactataaataggaatactcatgatcctctaattcagcaatcaacaccaacgaacacaaccttttccaaagccaataataaaagaacaaaagcttttagtttcatcaaagacgaagctgccttagaa

SEQ ID NO: 266 - DNA, 1000 bp, Arabidopsis thaliana
  misc_feature: Ceres Promoter YP0388
agaagtattcacgcaccaaggttatatttgtagtgacatattctacaattatcacatttttctcttatgtttcgtagtcgcagatggtcaattttttctataataatttgtccttgaacacaccaaactttagaaacgatgatatataccgtattgtcacgctcacaatgaaacaaacgcgatgaatcgtcatcaccagctaaaagcctaaaacaccatcttagttttcactcagataaaaagattatttgtttccaacctttctattgaattgattagcagtgatgacgtaattagtgatagtttatagtaaaacaaatggaagtggtaataaatttacacaacaaaatatggtaagaatctataaaataagaggttaagagatctcatgttatattaaatgattgaaagaaaaacaaactattggttgatttccatatgtaatagtaagttgtgatgaaagtgatgacgtaattagttgtatttatagtaaaacaaattaaaatggtaaggtaaatttccacaacaaaacttggtaaaaatcttaaaaaaaaaaaaagaggtttagagatcgcatgcgtgtcatcaaaggttctttttcactttaggtctgagtagtgttagactttgattggtgcacgtaagtgtttcgtatcgcgatttaggagaagtacgttttacacgtggacacaatcaacggtcaagatttcgtcgtccagatagaggagcgatacgtcacgccattcaacaatctcctcttcttcattccttcattttgattttgagttttgatctgcccgttcaaaagtctcggtcatctgcccgtaaatataaagatgattatatttatttatatcttctggtgaaagaagctaatataaagcttccatggctaatcttgtttaagcttctcttcttcttctctctcctgtgtctcgttcactagttttttttcgggggagagtgatggagtgtgtttgttgaatagttttgacgatca

SEQ ID NO: 267 - DNA, 283 bp, Arabidopsis thaliana
  misc_feature: Ceres Promoter PD0901
caaagtatttgacaagccatatggttttggatcaaaaagtcggtccaaaattaatgttttatgtgcaagaaccgacccattgtacacacgtgttaacatcttcaagactttcatctctatttttcttttggtcattaagatacccattgatccgaatctgttacattcccacctacttttttaatttttactatccactccaaattaaacacaaccgatgattttaataattggaagctttttaaaatatttctccacgtgcctctttgtgtttgtctatata

SEQ ID NO: 268 - DNA, 1000 bp, Arabidopsis thaliana
  misc_feature: Ceres Promoter PT0623
aaagttattgacattttgaaaggaccgtaaatattaccaaaaaactgacggagttaggatcggccacgtagaaagggacaaagagagaacagtcacggactcggccagactaagtatgggcctgtctgaatccaaactcagctaagttccaaaagcataaagagagatgtgtaatgaaatgaacgtattctagaaacgaaagcaatgttatgctttgtttttgagccacatgtttttgggagatggagagaatcttttttacgtttttaacctaacccacttggcacttggccaaaaaagtgagaagaaactgtggcgaatgagtaggccacgccatggactttgttccttgtccttcaaaagttaaatttatgttatgcgtggggacaatctaagcaacgtggttcctttaaatatcgcagcttcctcttttacacttttggagcctacgtgttttgttttggaccggccaaatacacgagtcagtcagtttagaaataatttggatgtccaaaaatcttggagatccaaataaaataattagcatgttttagttcataagaatatgaaatgtagataaactgtctatattaatttttccatagaattggctttttatcgaggtgatgtacttaatgactttgttgattactactcgtataacaataaagaatatgatactatgtgagacttataatgaatttggtgtgtgttaattaatccagttgaaacagtttaataacaaatcagaataaaaattgtagtaagaaaatttgaacgctgatccttcaacctagatagtgaacctttcaaatactatatgattcacgtgtaatgtttttgaccgttggttatttttgtgtgaactatattaacttatcaatatcgaaaggctaaataagtaaataactaaaagaaagttcaggaaacaactcgacctaatgacctatcatttctgatcacccgtcctataaatacatacgtaagatcattcgttact

SEQ ID NO: 269 - DNA, 873 bp, Glycine max
  misc_feature: Ceres CLONE ID no.565421
  misc_feature: Encodes the peptide sequence at SEQ ID NO 270
tcaacataactgttgttcccttctttgcactgcaaattccctgtgcatgtattagtttttgattgatttttttttctctgaggggggcacattaattgtgctcaatactcatacattgcggttcctttattattttgtaattcattacattgatattgattaacatgtcatttgtcaaaaagagtctaatttagttggttgatcagagtgtgtgatagtcttcgattccacggattaaagaaaaattaacatgtcatcaaagcttcaagttcagcagcttaatcagttaagggagattttcggtcgatttgacatggactcagatggaagcctaacaatgctagagctagcagcacttcttaggtctctggggctgaagccctcgggtgaccaagtccaagcactgttagccaacatggactcaaacgccaatggcaaagtggagtttgatgaattgataagagccatattacctgacataaatgcacaggttttgctgaaccaagaacagctcctaggggtgttcaagtgcttcgatcgcgacggcaacggttacatatcggccgcagagttggccggggcaatggccaaaatgggccagccactcacgtaccgagagctcacggagatgatcaaagaggctgacacggatggggatggtgttattagcttcactgagtttgccactatcatggctcgctctgcttctgattttctaggcctctcgttctgctgaccgtataacatatattcatttcatctaagttgtacaatattcttgattttttttccttttgaatgaatgaatcaatcaaataatgatatttggtttgtactgggtattactaatactaattacccacaattcctgcc

SEQ ID NO: 270 - protein, 161 aa, Glycine max
  misc_feature: Ceres CLONE ID no. 565421
  misc_feature (1)..(161): Functional Homolog of Ceres Clone ID no. 29658 at SEQ ID NO. 123
  misc_feature (87)..(115): Pfam Name: efhand Pfam Description: EF hand
MSSKLQVQQLNQLREIFGRFDMDSDGSLTMLELAALLRSLGLKPSGDQVQALLANMDSNANGKVEFDELIRAILPDINAQVLLNQEQLLGVFKCFDRDGXGYISAAELAGAMAKMGQPLTYRELTEMIKEADTDGDGVISFTEFATIMARXASDFLGLSFC

SEQ ID NO: 271 - DNA, 842 bp, Arabidopsis thaliana
  misc_feature: Ceres CLONE ID no.3747
  misc_feature: Encodes the peptide sequence at SEQ ID NO 272
actttttctccaatggcttctctgaagctttcaccttcttctccaatctccatttctaaggttggtgtgattccttcctctaagaaaggactttcatttcttgtaaaagcagagcaccattcctcgtcttcttcttctcatcttcaagataaatgtcagagacgtctgattgtaacatttggtgttgttgctccttggatctcattgcttagtagagctccattatcatttgctgcagaaagcaaaaaaggattccttgctgtctctgacaataaagatgcttatgcgtttctctatccatttggttggcaggaagttgtgattgaaggtcaagataaggtatacaaagatgtgattgagcctttagaaagtgttagtgtgaatttggtcccaactagcaaacagactattaaagaatttggccctcccaagcagatagctgaaacactgataaagaaagttttggcacctccaaatcagaaaacaacccttattgatgcatcagagcatgatgtcgatgggaagacttattatcagtttgagttcactgttcaagctagaaactacactcgccatgctctgggtaccatcacggttttcaacggaaacttctacacactgacgacgggagcgaatgaaaggaggtgggagaagatgaaagataggcttcacactgtggtagattccttcaagatcactgtttgaaaatactgtaatcaagtttgctttggttgtctcttgttttgcccatttcttgtatttttgtccattcttcttctctctttcccttaacaatattcttttcctgtaagagagattcaataactcttgacttgcctccc

SEQ ID NO: 272 - protein, 230 aa, Arabidopsis thaliana
  misc_feature: Ceres CLONE ID no. 3747
  misc_feature (1)..(230): Functional Homolog of Ceres Clone ID no. 16403 at SEQ ID NO. 146
  misc_feature (43)..(229): Pfam Name: PsbP Pfam Description: PsbP
MASLKLSPSSPISISKVGVIPSSKKGLSFLVKAEHHSSSSSSHLQDKCQRRLIVTFGVVAPWISLLSRAPLSFAAESKKGFLAVSDNKDAYAFLYPFGWQEVVIEGQDKVYKDVIEPLESVSVNLVPTSKQTIKEFGPPKQIAETLIKKVLAPPNQKTTLIDASEHDVDGKTYYQFEFTVQARNYTRHALGTITVFNGNFYTLTTGANERRWEKMKDRLHTVVDSFKITV

SEQ ID NO: 273 - DNA, 1205 bp, Arabidopsis thaliana
  misc_feature: Ceres CLONE ID no.34878
  misc_feature: Encodes the peptide sequence at SEQ ID NO 274
acaacactcgacacagaagcaaaaacaaaaatgggtgagaaagatattccaaggaacttgaaggaagaagaagaaaaccaaagtgaagattccaaaagtttgatctcttcacttccttcagacatagattgctctgggaccaagttgtacaagtatcaaggatgttggtacgataaagacattctccaagcaatcctcaaattcaacaaaatctttcagccacaagaaaccgatataattgttgcttctttccccaaatcaggtacgacttggctcaaggcactcacattcgcactcgctcaaagatcaaaacatacttcagaaaatcatcctctgctaactcataatcctcatgagctagtgccgtacctcgagctcgatctttatctcaaaagctcgaaaccggatatgtccaagttaccatcatcatctccgagattgttctcaacccacatgtctttcgatgcgcttaaagtaccaatgaaggagactccttgcaagatagtgtatgtgtgcaggaacgtaaaagacgtgttggtatcactttggtgtttcgaaaactccattagtggagaaaacaatttaagtctcgaggctttgttcgagtctttatgtagcggagttaacttatgcggtcccttgtgggaaaatgtgttaggctattggagaggaagcttggaagatcctaagcatgtgcttttcttgaggtacgaggagttgaagacggagcctcgtgtgcaaatcaagagacttgcagagttcttagattttccattcacaaaggaagaagaagatagtggaggtgtagacaagatcttggaactttgttctctaagaaaccttagcggtttggagatcaacaaaacaggaagcttgtcggaaggagtaagtttcaagagttttttccgtaaaggggaagttggtgattggaagagttatatgactcctgaaatggaaaacaaaatcgacatgattgttgaggagaaacttcaaggctctggtttgatattgtagagttcatatctctatgtatatgtgaacaggtttaatctcaaacctaataatgctggtttgttcttttcttgtatgcaatgtaataaaagttactttgatgtaaggttaagagtttaagattctgagcgatgtgtcgtttttgtttcctttgataatcaataaagctagcggcttttcttcttcgccaaggc

SEQ ID NO: 274 - protein, 327 aa, Arabidopsis thaliana
  misc_feature: Ceres CLONE ID no. 34878
  misc_feature (1)..(327): Functional Homolog of Ceres Clone ID no. 3964 at SEQ ID NO. 154
  misc_feature (66)..(324): Pfam Name: Sulfotransfer_1 Pfam Description: Sulfotransferase domain
MGEKDIPRNLKEEEENQSEDSKSLISSLPSDIDCSGTKLYKYQGCWYDKDILQAILKFNKIFQPQETDIIVASFPKSGTTWLKALTFALAQRSKHTSENHPLLTHNPHELVPYLELDLYLKSSKPDMSKLPSSSPRLFSTHMSFDALKVPMKETPCKIVYVCRNVKDVLVSLWCFENSISGENNLSLEALFESLCSGVNLCGPLWENVLGYWRGSLEDPKHVLFLRYEELKTEPRVQIKRLAEFLDFPFTKEEEDSGGVDKILELCSLRNLSGLEINKTGSLSEGVSFKSFFRKGEVGDWKSYMTPEMENKIDMIVEEKLQGSGLIL

SEQ ID NO: 275 - DNA, 1459 bp, Zea mays
  misc_feature: Ceres CLONE ID no.295570
  misc_feature: Encodes the peptide sequence at SEQ ID NO 276
acgcagggtggctaggagttgagtcgtgcagaagagacaaaggtcctcacttggctaagctagacacgtacgagtgcaggaaacaagataagtcgcggtttgcgacggcgagaagcgccggatgagtgtccactgtccacaagtccagattccaattccagtccgatcgtgagctcagctcagctccgctagtcctctccccgcacgcaccaccaccagcagcagtccagcaccatgggcggcgccctgctcctcacgctgctcctcgcggccgtgcccctctccktgggcggcggcggcggcgcgcacccgggctactccgacgacgacgagagcgcctgcacggtggacgcgggcgcggagctgctgcggcggatsgaggagcgcgggcccgacaggcgcatcatcgacatcacgcacgcggtcgtgcmggacctgccggcgttcgccacgggggcggtcgcggggcccatgctgcgcctcagggagtcsatggcggacgggtcgcgagtacaacctgtcggagctgcggatggagtgccacaccggcacgcacgtcgacgcgcctggccacatcaaccaggcccacttsgccgcctgcctcgacgtcgacacgctcgacctccacgtcctcaacggacctgcattgctagttgatgtgccaagaaacacaaatataacagctgaagcgatggaattcctaaacatcccgagaggggttcgccgagttctgttcagaacactgaacactgacaggaagttgatgtggaggaagggaggtgacatgagctacgttgggtttacagaggatggcgcgcastggttagtcgacaacaccgacataaagctagttggagttgacggtctgtcagwggcatcatttgatcacctgatctctgcccacgtggtcttttttcaaaaaaccccggatataatccctgttgagagcctsaatctggacgacatcgaggcggggatatacatgctgcactgtctacctctcaggctggtcggagccgagggtgcaccgaccagatgcatcctcatcaagtgatcgttcctcggccggcctgctcttgctgccttgctggaggtggcgacactggaccatgyccagctgagctggtgctccgtcgtgggtcgcgtggccaatatttggctcgcatgcagtcgtcgatctatatggaacagaacactgcatgcctatgtagatacgcttgtatggacaataaaggaaccgcagtacttctgtcgawgaaatastwkkgggtgrgmcggtaatstaaaacacsaggcmtactwggttaagctgggaggccctgsmwaggctgaggmtrgmggctggggatggatccagagttttwattcgaatgstatttttttttgggycmtattttctttgattgtaracraataacatatatgattttctatatctctactaaaaaaaaaaaaaaaa

SEQ ID NO: 276 - protein, 271 aa, Zea mays
  misc_feature: Ceres CLONE ID no. 295570
  misc_feature (1)..(271): Functional Homolog of Ceres CLONE ID no. 8686 at SEQ ID NO. 80
  misc_feature (57)..(257): Pfam Name: Cyclase Pfam Description: Putative cyclase
MGGALLLTLLLAAVPLSLGGGGGAHPGYSDDDESACTVDAGAELLRRMEERGPDRRIIDITHAVVPDLPAFATGAVAGPMLRLRESMADGSEYNLSELRMECHTGTHVDAPGHINQAHFAACLDVDTLDLHVLNGPALLVDVPRNTNITAEAMEFLNIPRGVRRVLFRTLNTDRKLMWRKGGDMSYVGFTEDGAQWLVDNTDIKLVGVDGLSVASFDHLISAHVVFFKTPDIIPVESLNLDDIEAGIYMLHCLPLRLVGAEGAPTRCILIK

SEQ ID NO: 277 - DNA, 1212 bp, Arabidopsis thaliana
  misc_feature: Ceres CLONE ID no.150484
  misc_feature: Encodes the peptide sequence at SEQ ID NO 278
acaacactcgacacaaaagcaaaaacaaaaatgggtgagaaagatattccaaggaacttgaaggaagaagaagaagaagaagaagaaaaccaaagtgaagaaaccaaaagtttgatctcttcacttccttcagacatagattgctcagggaccaagttgtacaagtaccaaggatgttggtacgacaaagatattctccaagcaatcctcaatttcaacaaaaactttcagccacaagaaacggatataattgttgcttctttccccaaatcgggtacgacttggctcaaggcactcacattcgcactcgcgcaaagatcaaaacacacttcagacaatcatcctctgctaactcataatcctcatgagctagtgccgtacctcgagctcgatctttatctcaaaagctcgaaaccggatttgaccaagttgccatcatcatctccgagattgttctcaacccacatgtcctttgatgcgcttaaagtaccgttgaaagagtctccttgcaagatcgtgtacgtgtgcaggaacgtgaatgacgtattgatatcactttggtgtttcgaaaactccatgagtggagaaaacaatttaagtctcgaggctttgttcgagtctttatgtagcggagttaacttatgcggtcccttatgggaaaatgtgttaggctattggagaggaagcttggaagatcctaagcatgtgcttttcttgaggtacgaggagttgaagacggagcctcgtgtgcaaatcaagagacttgcagagttcttagattgtccattcacaaaggaagaagaagatagtggaggtgtagacaagatcttggaactttgttctctaagaaaccttagcggtttggagatcaacaaaacaggaagcttgtcggaaggagtaagtttcaagagttttttccgtaaaggggaagttggtgattggaagagttatatgactcctgaaatggaaaacaaaatcgacatgattgttgaggagaaacttcaaggctctggtttgaaattgtagagttcatatctctatgtatatgtgtgggaacaggtttaatctcaaacctaataatgctggtttgttcttttcttgtatgcaatgtaataaaagttactttgatgtaaggttaagagtttaagattcttagtgatgtgttgttgtttttgtttcgtttgataacgaataaagctagcggcttttctc

SEQ ID NO: 278 - protein, 331 aa, Arabidopsis thaliana
  misc_feature: Ceres CLONE ID no. 150484
  misc_feature (1)..(331): Functional Homolog of Ceres Clone ID no. 3964 at SEQ ID NO. 154
  misc_feature (70)..(328): Pfam Name: Sulfotransfer_1 Pfam Description: Sulfotransferase domain
MGEKDIPRNLKEEEEEEEENQSEETKSLISSLPSDIDCSGTKLYKYQGCWYDKDILQAILNFNKNFQPQETDIIVASFPKSGTTWLKALTFALAQRSKHTSDNHPLLTHNPHELVPYLELDLYLKSSKPDLTKLPSSSPRLFSTHMSFDALKVPLKESPCKIVYVCRNVNDVLISLWCFENSMSGENNLSLEALFESLCSGVNLCGPLWENVLGYWRGSLEDPKHVLFLRYEELKTEPRVQIKRLAEFLDCPFTKEEEDSGGVDKILELCSLRNLSGLEINKTGSLSEGVSFKSFFRKGEVGDWKSYMTPEMENKIDMIVEEKLQGSGLKL

SEQ ID NO: 279 - DNA, 1155 bp, Arabidopsis thaliana
  misc_feature: Ceres CLONE ID no.1368
  misc_feature: Encodes the peptide sequence at SEQ ID NO 280
aaatcaccaaccagtgacctaacaatggccgttcctccattattcttcctcctcacactcctctctctcccttctcttcttatctccgccggtgcttccaatgcctatccttctattcccggaaccgctcctatcgacggaggtttcaccgatgaacttaaacccattcgccgtgaagtctacgggaatggcaaaatctatgacatcagtcaccgttacactccggagatgccgtcgtgggactcatcggaaggaatcggacggttcctatggttagctgcgagtatgaagaacggatctcttgctaataactctgaaatgaagattcccacgcacactggtactcatgttgattcacctggtcacgtctatgacaagtattacgatgctggctttgatgttgactcgcttgatcttcaagtcctcaatggtcttgcgttgttggttgatgttccaaaggataagaacattactgctgaagtgatgaaatctcttcacattccaaaaggagttagtcgtgtgcttttcagaacattgaacactgacaggcgtcttatgttcaagaaagaatttgatacaagctatgtcggattcatgaaggatggtgcgcaatggttggtagacaacacagacatcaaacttgttgggattgattatctatcagtagctgcatatgatgatcttattccatcccacctagtattcctaaaagaccgggagactatactcgtgraggggttgaagctggatggtgtgaaggcaggactctactctgtccattgcttacctctaagactggttggagcagaagggtctccaattcgttgcatcctcatcgattgattctctcccatcacaaacctgccaaatccgaaattgtccgtaatcaaaagcttgcttagcttatgaactgaatatcagtttgtgctagatttatgcaaccaatatggagattgaagtaggaagaaataagagagatgcagagaagaccaagttgatgataatgaagcaccgaagaaaaaagatttttcatttctatgtatatgtcaataaataaattaaaaattctcttaatctgtcaaggttgtactaattatcaaatagggaaaagttcataacatataaatccttgttgaaataggtttttgttttccc

SEQ ID NO: 280 - protein, 272 aa, Arabidopsis thaliana
  misc_feature: Ceres CLONE ID no. 1368
  misc_feature (1)..(272): Functional Homolog of Ceres CLONE ID no. 8686 at SEQ ID NO. 80
  misc_feature (58)..(258): Pfam Name: Cyclase Pfam Description: Putative cyclase
MAVPPLFFLLTLLSLPSLLISAGASNAYPSIPGTAPIDGGFTDELKPIRREVYGNGKIYDISHRYTPEMPSWDSSEGIGRFLWLAASMKNGSLANNSEMKIPTHTGTHVDSPGHVYDKYYDAGFDVDSLDLQVLNGLALLVDVPKDKNITAEVMKSLHIPKGVSRVLFRTLNTDRRLMFKKEFDTSYVGFMKDGAQWLVDNTDIKLVGIDYLSVAAYDDLIPSHLVFLKDRETILVEGLKLDGVKAGLYSVHCLPLRLVGAEGSPIRCILID

SEQ ID NO: 281 - DNA, 1273 bp, Arabidopsis thaliana
  misc_feature: Ceres CLONE ID no.124067
  misc_feature: Encodes the peptide sequence at SEQ ID NO 282
accaacacacaaagattccattacaaataaacaattttcatatatatctataacaaaaaaaaacaatggcgacctcaagcatgaagagcattccaatggcgatcccaagtttctccatgtgtcacaagctcgagctccttaaagaaggcaaaactcgcgacgtcccgaaagccgaagaagatgaagggctaagctgcgagttccaagagatgttggattctcttcctaaggagagaggatggagaactcgttacctttacctattccaagggttttggtgccaagccaaagagattcaagccatcatgtctttccaaaaacatttccaatccctcgaaaacgacgtcgttctcgccaccatacctaaatccggtacaacctggctaaaagctttaactttcaccatccttaaccgtcaccggtttgatccggttgcctcgagtaccaaccaccctcttttcacttccaaccctcatgaccttgtacctttcttcgagtacaagctttacgccaacggagatgttcccgatctctcgggtctagccagtccaagaacgttcgcaacccacttaccgttcggttccttaaaggaaacgatcgagaaacccggtgtgaaggtcgtgtacttgtgccggaacccgtttgacacattcatctcttcgtggcattacaccaacaacatcaaatccgagtcagtgagcccagtcttgctagaccaagcttttgatctgtattgccggggagtgatcgggtttggcccgttttgggaacacatgttgggatactggagagagagcttgaagagaccagagaaagtcttctttttaaggtacgaggatctcaaagacgacatcgagaccaacttgaagaggcttgcaactttcttagagcttcctttcaccgaagaagaggaacgaaagggagttgtgaaggctatcgccgagctgtgtagcttcgagaatctgaagaagttggaggtgaacaagtcaaacaagtcgatcaagaactttgagaatcgattcttgtttcggaaaggagaagtgagtgattgggttaactatttgtcaccttcacaagtggaaagattgtcagccttagtggatgacaagttaggtggatctggtctcactttcaggttgagctaaatataaggccacgtgcccccatttctactcttgttctgagggcctactatatacgttaagctaagttaaggcagttgtattgttgttacagatagacatcgaagcaacgtaacgtccataattaagtc

SEQ ID NO: 282 - protein, 359 aa, Arabidopsis thaliana
  misc_feature: Ceres CLONE ID no. 124067
  misc_feature (1)..(359): Functional Homolog of Ceres Clone ID no. 3964 at SEQ ID NO. 154
  misc_feature (91)..(353): Pfam Name: Sulfotransfer_1 Pfam Description: Sulfotransferase domain
MATSSMKSIPMAIPSFSMCHKLELLKEGKTRDVPKAEEDEGLSCEFQEMLDSLPKERGWRTRYLYLFQGFWCQAKEIQAIMSFQKHFQSLENDVVLATIPKSGTTWLKALTFTILNRHRFDPVASSTNHPLFTSNPHDLVPFFEYKLYANGDVPDLSGLASPRTFATHLPFGSLKETIEKPGVKVVYLCRNPFDTFISSWHYTNNIKSESVSPVLLDQAFDLYCRGVIGFGPFWEHMLGYWRESLKRPEKVFFLRYEDLKDDIETNLKRLATFLELPFTEEEERKGVVKAIAELCSFENLKKLEVNKSNKSIKNFENRFLFRKGEVSDWVNYLSPSQVERLSALVDDKLGGSGLTFRLS

SEQ ID NO: 283 - DNA, 845 bp, Arabidopsis thaliana
  misc_feature: Ceres ANNOT ID no.870567
  misc_feature: Encodes the peptide sequence at SEQ ID NO 284
aataagaaaatcaaaatctttactcgtttgaaatttgtaatccattacctgtcatcgttgacttgtcaagaagaaacaaatcaactctaaaaagaaaaatgttgttcatcgaaatcgaagcttgacagtattcaaaatcagattcgagatgagctgcgacggaggcaaaccggcgccggcgaaactaggcgacgaacaactagcggagctccgggagatattccgatcatttgaccagaacaaggatggaagtttgacggagctcgagttaggctcacttctaagatctctcggtctaaagccgagtcaagaccaactcgacacattgatccagaaagcagatcggaataacaacggactggtcgagttctccgagttcgtcgccctcgtcgagccagatctggtcaagtgtccttacacggatgatcagcttaaagccatctttagaatgtttgaccgcgatggaaacggttacataacggcggcggagttagcccattcgatggcgaagctaggtcacgcgttgacggcggaggagttaacgggaatgatcaaagaagctgatcgagacggcgatggttgtattgatttccaagagtttgttcaagcgattacttcagctgcgtttgataatgcttggggttgaagaaagaaaggtatatatatacatagtttgaaatacttgtgttttgtttttttggcttcatcctcaaatcaaagacatttggaagtatatgtgtgtaggtgcgattccatggaaaatgtgtgttatttattgtttcatattattctttgatgaaattttgatagcttgaagagaaagctatcattgttggttttagggc

SEQ ID NO: 284 - protein, 165 aa, Arabidopsis thaliana
  misc_feature: Ceres ANNOT ID no. 870567
  misc_feature (1)..(165): Functional Homolog of Ceres Clone ID no. 29658 at SEQ ID NO. 123
  misc_feature (56)..(84): Pfam Name: efhand Pfam Description: EF hand
MSCDGGKPAPAKLGDEQLAELREIFRSFDQNKDGSLTELELGSLLRSLGLKPSQDQLDTLIQKADRNNNGLVEFSEFVALVEPDLVKCPYTDDQLKAIFRMFDRDGNGYITAAELAHSMAKLGHALTAEELTGMIKEADRDGDGCIDFQEFVQAITSAAFDNAWG

SEQ ID NO: 285 - DNA, 1248 bp, Arabidopsis thaliana
  misc_feature: Ceres ANNOT ID no.864284
  misc_feature: Encodes the peptide sequence at SEQ ID NO 286
gttcacttaacaaaacaagaaccaaaaaaaatggatgagaaagatattctaaggaacttgagggaagaagaagaagaagaagaagaaaatcaaagcgaagaaaccaaaattttgatctcttcacttccttgggagatagattaccttgggaacaagcttttcaagtaccaaggatattggtactacgaagacgttctccaatcaatccccaatatacactcgagttttcagccacaagaaaccgatatagttgttgcttctttctacaaatcgggcacgacttggctcaaagcactcacatttgcactcgttcaacgatcaaaacactcgttagaagatcatcatcatcctctgctatctcataaccctcatgagatagtaccgtacctcgagctagatctgtatctcaacagctcaaaaccggacttgaccaagttcttatcatcatcatcatcatcatcatctccgagattgttctcaactcatatgtccttggacgcgcttaaactacccttgaagaagtctccttgcaaggtagtgtacgtgtgcaggaacgtgaaagacgtgttggtgtcactttggtgtttcctcaatgccaacaagggagtagaatggggagattttagccaaaatgaaaagatcattcgagcggagaattattctttcaaggctatatttgagtcattctgcaacggagttaccctacacggtcccttttgggaccatgcacagagctattggcgaggcagcttggaagatcctaagcattttcttttcatgaggtacgaggagttgaaagcggagcctcgtactcaggtcaagagacttgcagagttcttggattgtccattcactaaggaagaggaagatagcggaactgtagacaagatcttggaactttgctctctaagtaatttaagcagtttggagatcaacaaaactggatccttgggtggagtagattacaagacttatttccgtaaaggacaagttggtgactggaagagttatatgacctctgaaatggtaaataaaatcgatatgatcgtcgaggagaaactcaaaggttccggtttgaaattctagaattatgcgtgtgctttgtgaagaactgcagaaaaagtgttcttgaatgcgttatttaataataaaagttacattgtcatatatataactttgatgtatcattacaactgatgtgtggtttttgttctctttgatgttgcaataaaaaccttctttacttct

SEQ ID NO: 286 - protein, 351 aa, Arabidopsis thaliana
  misc_feature: Ceres ANNOT ID no. 864284
  misc_feature (1)..(351): Functional Homolog of Ceres Clone ID no. 3964 at SEQ ID NO. 154
  misc_feature (70)..(348): Pfam Name: Sulfotransfer_1 Pfam Description: Sulfotransferase domain
MDEKDILRNLREEEEEEEENQSEETKILISSLPWEIDYLGNKLFKYQGYWYYEDVLQSIPNIHSSFQPQETDIVVASFYKSGTTWLKALTFALVQRSKHSLEDHHHPLLSHNPHEIVPYLELDLYLNSSKPDLTKFLSSSSSSSSPRLFSTHMSLDALKLPLKKSPCKVVYVCRNVKDVLVSLWCFLNANKGVEWGDFSQNEKIIRAENYSFKAIFESFCNGVTLHGPFWDHAQSYWRGSLEDPKHFLFMRYEELKAEPRTQVKRLAEFLDCPFTKEEEDSGTVDKILELCSLSNLSSLEINKTGSLGGVDYKTYFRKGQVGDWKSYMTSEMVNKIDMIVEEKLKGSGLKF

SEQ ID NO: 287 - DNA, 1177 bp, Arabidopsis thaliana
  misc_feature: Ceres ANNOT ID no.858178
  misc_feature: Encodes the peptide sequence at SEQ ID NO 288
atagagagcttaagcaaaagatctcatactttcaagattgatcgatctctcaagtctcaacaatgtcatcatcatcatcagttcctgcttacttgggagatgaagatctgacacaagaaacaagagctctgatctcttctcttcctaaagagaaaggttggttagtgagtgaaatatatgaattccaaggactttggcacacacaagctattttacaaggaatcttgatctgccaaaaacgctttgaagctaaagattccgacattatcctcgtcactaatcctaaatcaggtaccacttggttaaaagctcttgtctttgctctccttaaccgacacaagtttccagtttcttcttctggtaaccatcctcttctggtcaccaatccacaccttcttgtgcccttcttggaaggagtttactacgagtccccagatttcgatttctccagtttgccttctccaagactgatgaacacgcacatatcgcatctttcgctccccgagtctgttaagagctcgtcttgtaagattgtgtattgttgtaggaaccctaaggacatgtttgtgtccttatggcattttgggaaaaagctagctcctgaggaaaccgcggattatcctatcgaaaaagcggttgaagcgttttgtgaagggaagtttataggtggacccttttgggatcatatattggagtactggtatgcaagccgcgagaatccgaacaaggtcttgtttgttacttacgaggagctaaagaagcagaccgaagttgagatgaagcggatcgcggagttcttggaatgtggctttattgaagaagaagaagtgagagagattgtgaagttgtgtagctttgagagtttaagtaatttggaagttaacaaagaagggaaattgccaaatggaatagagactaaaactttctttagaaaaggagagattggaggatggagagatactttgagtgagtcattggcagaggaaattgatagaaccattgaagagaagtttaaaggttctggtcttaaattttcttcttgaatcaatctttgaaacttgttctcatgttcttgttttgcttcaattatgttatttcttgttttatatatttttctgctgttatgtttgtgtttgtgtttatgaataaaatgaaataaattatgtttgtgttttct

SEQ ID NO: 288 - protein, 326 aa, Arabidopsis thaliana
  misc_feature: Ceres ANNOT ID no. 858178
  misc_feature (1)..(325): Functional Homolog of Ceres Clone ID no. 3964 at SEQ ID NO. 154
  misc_feature (65)..(321): Pfam Name: Sulfotransfer_1 Pfam Description: Sulfotransferase domain
MSSSSSVPAYLGDEDLTQETRALISSLPKEKGWLVSEIYEFQGLWHTQAILQGILICQKRFEAKDSDIILVTNPKSGTTWLKALVFALLNRHKFPVSSSGNHPLLVTNPHLLVPFLEGVYYESPDFDFSSLPSPRLMNTHISHLSLPESVKSSSCKIVYCCRNPKDMFVSLWHFGKKLAPEETADYPIEKAVEAFCEGKFIGGPFWDHILEYWYASRENPNKVLFVTYEELKKQTEVEMKRIAEFLECGFIEEEEVREIVKLCSFESLSNLEVNKEGKLPNGIETKTFFRKGEIGGWRDTLSESLAEEIDRTIEEKFKGSGLKFSS

SEQ ID NO: 289 - DNA, 486 bp, Arabidopsis thaliana
  misc_feature: Ceres ANNOT ID no.842118
  misc_feature: Encodes the peptide sequence at SEQ ID NO 123
atggcgtcaacaaaaccaaccgatcaaatcaaacaactcaaagatatcttcgctcgtttcgacatggacaaggacggaagcttaacgcagctagaactcgccgctcttctgcgttctctcggaatcaaacctcgcagcgatcaaatctctcttctgttgaaccaaatcgaccgtaacggtaacggatccgtagagttcgacgagctggtcgtggcgatattgccggatataaacgaagaggttttgataaatcaagaacagttgatggaggttttccgttcgtttgatcgtgacggaaacggttcaataacggcggcggaacttgctgggtcaatggctaaaatgggacatccgttgacttaccgtgaattaacggaaatgatgacggaagctgattctaacggtgacggtgttattagttttaatgagttttctcatattatggctaaatcggctgctgattttcttggattaaccgcttcttga

SEQ ID NO: 290 - DNA, 633 bp, Arabidopsis thaliana
  misc_feature: Ceres ANNOT ID no.566551
  misc_feature: Encodes the peptide sequence at SEQ ID NO 291
atggcggcgaacgattcttcaaatgctattgacatcgacgggaatctcgactccgattcgaatcttaacactgacggtgacgaagcgaccgataatgattcctcgaaggcattggttactatccctgctccagccgtttgtcttttccggttcgccggagatgctgctggtggcgccgttatgggctctatcttcggatatggttcaggattgttcaagaagaaaggcttcaaaggatcatttgcagatgcagggcagtctgctaagacttttgctgttttatctggagtccacagtttggttgtttgccttctgaagcaaatccgaggcaaagatgacgccattaatgttggagtagcagggtgttgcactggtcttgctcttagtttccctggtgctccacaggctcttctacagagttgtctcacgtttggggcattctcttttattcttgagggactcaacaaaagacaaacagctttggcacactcggtctcgttgagacaccaaaccggactgttccaagatcatcatcgtgctttaccactctctcttgctctcccgatccctgaagaaatcaaaggagccttttcttctttctgcaagtccttagctaaaccaaggaagttctaa

SEQ ID NO: 291 - protein, 210 aa, Arabidopsis thaliana; identical to SEQ ID NO: 173
  misc_feature: Ceres ANNOT ID no. 566551
  misc_feature (1)..(210): Functional Homolog of Ceres CLONE ID no. 965405 at SEQ ID NO. 172
  misc_feature (40)..(158): Pfam Name: Tim17 Pfam Description: Tim17/Tim22/Tim23 family

SEQ ID NO: 292 - DNA, 1323 bp, Arabidopsis thaliana
  misc_feature: Genomic Sequence Of Ceres ANNOT ID no. 566551
  misc_feature: Encodes the peptide sequence at SEQ ID NO 291
tggcggcgaacgattcttcaaatgctattgacatcgacgggaatctcgactccgattcgaatcttaacactgacggtgacgaagcgaccgataatgattcctcgaaggcattggttactatccctgctccagccgtttgtcttttccggttcgccggagatgctgctggtggcgccgttatgggctctatcttcggatatggtgctcttcttctttctattttgtttcttctattgcttggttttatctgctattgctttactctctgatagtgaattgagaattactggcaaacaattgagtttgtactcttttcttcatttaagttgatttcaaaacatgtttcgtggataagggtttgagaaatcatagttgttttagcagactagccttttgagttattttcaggagtaatctagatttaggggattcaacattcctcaagtttggttatgttttgctcctggaagctatagaattgaattagcttagttttcattaaagagcgtcaatgtgataagattggctactgatttgattacgatgatggaattgtgaaatattatctcactatataagttgggattcaggttcaggattgttcaagaagaaaggcttcaaaggatcatttgcagatgcagggcagtctgctaaggtacccctcatctttatgctatagcatatatatgcttattgttccaagaaactgagtaatttgctaattttttgttcaagacttttgctgttttatctggagtccacagtttggttgtttgccttctgaagcaaatccgaggcaaagatgacggtgagactcttcagattgcttccttcttgtgtaaatgattagtttttacatgaacttgtaatctctctcctacttatattgcttttgttctttttttacagccattaatgttggagtagcagggtgttgcactggtcttgctcttagtttccctggtaatccaaatccattatgctcattctgatttctactttggcgttatgtatcatatcaaagatgcaatcatcacagagaggagagctaatagattctttcttatatggccttttttacaggtgctccacaggctcttctacagagttgtctcacgtttggggcattctcttttattcttgagggactcaacaaaagacaaacagctttggcacactcggtctcgttgagacaccaaaccggactgttccaagatcatcatcgtgctttaccactctctcttgctctcccgatccctgaagaaatcaaaggagccttttcttctttctgcaagtccttagctaaaccaaggaagttctaat

SEQ ID NO: 293 - DNA, 486 bp, Arabidopsis thaliana
  misc_feature: Genomic Sequence Of Ceres ANNOT ID no. 842118
  misc_feature: Encodes the peptide sequence at SEQ ID NO 123
tggcgtcaacaaaaccaaccgatcaaatcaaacaactcaaagatatcttcgctcgtttcgacatggacaaggacggaagcttaacgcagctagaactcgccgctcttctgcgttctctcggaatcaaacctcgcagcgatcaaatctctcttctgttgaaccaaatcgaccgtaacggtaacggatccgtagagttcgacgagctggtcgtggcgatattgccggatataaacgaagaggttttgataaatcaagaacagttgatggaggttttccgttcgtttgatcgtgacggaaacggttcaataacggcggcggaacttgctgggtcaatggctaaaatgggacatccgttgacttaccgtgaattaacggaaatgatgacggaagctgattctaacggtgacggtgttattagttttaatgagttttctcatattatggctaaatcggctgctgattttcttggattaaccgcttcttgat

SEQ ID NO: 294 - DNA, 1177 bp, Arabidopsis thaliana
  misc_feature: Genomic Sequence Of Ceres ANNOT ID no. 858178
  misc_feature: Encodes the peptide sequence at SEQ ID NO 288
catagagagcttaagcaaaagatctcatactttcaagattgatcgatctctcaagtctcaacaatgtcatcatcatcatcagttcctgcttacttgggagatgaagatctgacacaagaaacaagagctctgatctcttctcttcctaaagagaaaggttggttagtgagtgaaatatatgaattccaaggactttggcacacacaagctattttacaaggaatcttgatctgccaaaaacgctttgaagctaaagattccgacattatcctcgtcactaatcctaaatcaggtaccacttggttaaaagctcttgtctttgctctccttaaccgacacaagtttccagtttcttcttctggtaaccatcctcttctggtcaccaatccacaccttcttgtgcccttcttggaaggagtttactacgagtccccagatttcgatttctccagtttgccttctccaagactgatgaacacgcacatatcgcatctttcgctccccgagtctgttaagagctcgtcttgtaagattgtgtattgttgtaggaaccctaaggacatgtttgtgtccttatggcattttgggaaaaagctagctcctgaggaaaccgcggattatcctatcgaaaaagcggttgaagcgttttgtgaagggaagtttataggtggacccttttgggatcatatattggagtactggtatgcaagccgcgagaatccgaacaaggtcttgtttgttacttacgaggagctaaagaagcagaccgaagttgagatgaagcggatcgcggagttcttggaatgtggctttattgaagaagaagaagtgagagagattgtgaagttgtgtagctttgagagtttaagtaatttggaagttaacaaagaagggaaattgccaaatggaatagagactaaaactttctttagaaaaggagagattggaggatggagagatactttgagtgagtcattggcagaggaaattgatagaaccattgaagagaagtttaaaggttctggtcttaaattttcttcttgaatcaatctttgaaacttgttctcatgttcttgttttgcttcaattatgttatttcttgttttatatatttttctgctgttatgtttgtgtttgtgtttatgaataaaatgaaataaattatgtttgtgttttc

SEQ ID NO: 295 - DNA, 1248 bp, Arabidopsis thaliana
  misc_feature: Genomic Sequence Of Ceres ANNOT ID no. 864284
  misc_feature: Encodes the peptide sequence at SEQ ID NO 286
ttcacttaacaaaacaagaaccaaaaaaaatggatgagaaagatattctaaggaacttgagggaagaagaagaagaagaagaagaaaatcaaagcgaagaaaccaaaattttgatctcttcacttccttgggagatagattaccttgggaacaagcttttcaagtaccaaggatattggtactacgaagacgttctccaatcaatccccaatatacactcgagttttcagccacaagaaaccgatatagttgttgcttctttctacaaatcgggcacgacttggctcaaagcactcacatttgcactcgttcaacgatcaaaacactcgttagaagatcatcatcatcctctgctatctcataaccctcatgagatagtaccgtacctcgagctagatctgtatctcaacagctcaaaaccggacttgaccaagttcttatcatcatcatcatcatcatcatctccgagattgttctcaactcatatgtccttggacgcgcttaaactacccttgaagaagtctccttgcaaggtagtgtacgtgtgcaggaacgtgaaagacgtgttggtgtcactttggtgtttcctcaatgccaacaagggagtagaatggggagattttagccaaaatgaaaagatcattcgagcggagaattattctttcaaggctatatttgagtcattctgcaacggagttaccctacacggtcccttttgggaccatgcacagagctattggcgaggcagcttggaagatcctaagcattttcttttcatgaggtacgaggagttgaaagcggagcctcgtactcaggtcaagagacttgcagagttcttggattgtccattcactaaggaagaggaagatagcggaactgtagacaagatcttggaactttgctctctaagtaatttaagcagtttggagatcaacaaaactggatccttgggtggagtagattacaagacttatttccgtaaaggacaagttggtgactggaagagttatatgacctctgaaatggtaaataaaatcgatatgatcgtcgaggagaaactcaaaggttccggtttgaaattctagaattatgcgtgtgctttgtgaagaactgcagaaaaagtgttcttgaatgcgttatttaataataaaagttacattgtcatatatataactttgatgtatcattacaactgatgtgtggtttttgttctctttgatgttgcaataaaaaccttctttacttcta

SEQ ID NO: 296 - DNA, 845 bp, Arabidopsis thaliana
  misc_feature: Genomic Sequence Of Ceres ANNOT ID no. 870567
  misc_feature: Encodes the peptide sequence at SEQ ID NO 284
ataagaaaatcaaaatctttactcgtttgaaatttgtaatccattacctgtcatcgttgacttgtcaagaagaaacaaatcaactctaaaaagaaaaatgttgttcatcgaaatcgaagcttgacagtattcaaaatcagattcgagatgagctgcgacggaggcaaaccggcgccggcgaaactaggcgacgaacaactagcggagctccgggagatattccgatcatttgaccagaacaaggatggaagtttgacggagctcgagttaggctcacttctaagatctctcggtctaaagccgagtcaagaccaactcgacacattgatccagaaagcagatcggaataacaacggactggtcgagttctccgagttcgtcgccctcgtcgagccagatctggtcaagtgtccttacacggatgatcagcttaaagccatctttagaatgtttgaccgcgatggaaacggttacataacggcggcggagttagcccattcgatggcgaagctaggtcacgcgttgacggcggaggagttaacgggaatgatcaaagaagctgatcgagacggcgatggttgtattgatttccaagagtttgttcaagcgattacttcagctgcgtttgataatgcttggggttgaagaaagaaaggtatatatatacatagtttgaaatacttgtgttttgtttttttggcttcatcctcaaatcaaagacatttggaagtatatgtgtgtaggtgcgattccatggaaaatgtgtgttatttattgtttcatattattctttgatgaaattttgatagcttgaagagaaagctatcattgttggttttagggca

SEQ ID NO: 297 - DNA, 2020 bp, Panicum virgatum
  misc_feature: Ceres CLONE ID no.1792902
  misc_feature: Encodes the peptide sequence at SEQ ID NO 298
gtcactctcggcactgctcccagctgttgcgacctccgaacatccaaggctcctgcacccctgtcagtcctagctccagccaaaaatcgttggctcccgctgcctgctcctccgccttgcacctcccatgaccttccacgcgacatgattgcattgcaggcccctgcggagctcagctgtcctcccacgccgctgacgccttcttgttgcctccacgctgctgcgctcaaccgaaagggccttcctctctttgcttccgcggaaggatttggcgatttattcatctactaaagttgcatctctcttgtgcgtggtgattgtttcgaggagcgtggagcggagccatggggaagaagggcaagtggttcggcgcggtcaagaaagtgttcagccctgaatccaaggagaagaaggaggagaggcagaggaggaaatcagcagctagcaaccctactccactagatctgaccccgtcgacctccttggaagtcaatgtttcggtgccaccccctccagctcctccggctcttcaccagattaaggaggtcaggatccctgaagctgagcaggagcagagcaagcacatcaccgtagaggaggcccctgctgcccctgcacaggcgtcggtgcttccacctggtgtgccaagtgaagagcttgctgcaatcaagatccagactgccttccgaggttacctggcaaggagggcactgcgagcgctgcggggccttgttcgattgaagtcattggttgagggtgattcagttaggcgtcaatctgcaagcactctgcgctgtatgcagactctatcgcgggtgcagtcacaaatacgttctaggagagcaaagatgtctgaggagaaccaggccctccagcgccagctcctactgaagcaggaactggagaatttcaggatgggtgagaactgggatgacagcactcaatccaaagagcaaatcgaggcgagcctaataagcaggcaagaggcagcgattagaagagaaagagcgcttgcatatgcattttcacatcagtggaagagcacgtcgaggtctgtcaacccaatgtttgtagacccaaacaacttgcagtggggctggagctggctggagcgctggatggctgcaaaaccttgggagggccgcaatgggactgataaggagagcaatgttgaccgtggatccgttaagagcatgagcttgaaccttggagagggtgagatcactaaagctttcaaccgccgggactcaaagccagaaaagccatccccgccaactccaaaactgacccgtccagcctccaggcaatccccttcaacgccctccgctaaagtagcgccaatacctgtgaggagaaaatccgtcacgccaaagaatgggctttcacatgtggatgacgatgcgagaagtgtgttcagtgtgcagtctgagcgaccaaggaggcacagtatagccacctcgactgtgcgggacgatgagagtctcgcaagctccccatcactcccaagttatatggttcccacagaatctgcaagggcgaagtctcgtctccagggatcagcattgaataatggtgcagagacaccagagaaaggaagctctgctggaccggtcaagaaaaggttgtcctttcaaggtggaacagcggctgcctcaccaatgcgacggcattctggtcctcccaaggtggggagtgcggtgaaggatattgttgccccaccacagccagaggccttggtgatcaatggtggaagcaagtgactcatgacaagtaccaggagggtaaagcggacaatgaatatatattttatccatgaagaaaggttaacgtgatatcagctctatgagtgatttgaattgttttccagttacgaccacattgtttgctctataagattcacagtacctgccagttgattccattcgttgtttctgtaaaacaagtaccggttcgtcactagaatcagtgatgtttgtatgtaaacaggtcttctatttatgtaaaaaaaaaaaaaaaaaaa

SEQ ID NO: 298 - protein, 471 aa, Panicum virgatum
  misc_feature: Ceres CLONE ID no. 1792902
  misc_feature (104)..(124): Pfam Name: IQ Pfam Description: IQ calmodulin-binding motif
  misc_feature (1)..(500): Functional Homolog of  Ceres Ceres Clone ID no. 375578 at SEQ ID NO. 252 with e-value of 1.90e-67 and BLAST sequence identity of 51.7
MGKKGKWFGAVKKVFSPESKEKKEERQRRKSAASNPTPLDLTPSTSLEVNVSVPPPPAPPALHQIKEVRIPEAEQEQSKHITVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGRNGTDKESNVDRGSVKSMSLNLGEGEITKAFNRRDSKPEKPSPPTPKLTRPASRQSPSTPSAKVAPIPVRRKSVTPKNGLSHVDDDARSVFSVQSERPRRHSIATSTVRDDESLASSPSLPSYMVPTESARAKSRLQGSALNNGAETPEKGSSAGPVKKRLSFQGGTAAASPMRRHSGPPKVGSAVKDIVAPPQPEALVINGGSK

SEQ ID NO: 299 - DNA, 1880 bp, Gossypium hirsutum
  misc_feature: Ceres CLONE ID no.1919901
  misc_feature: Encodes the peptide sequence at SEQ ID NO 300
aacttttcttagttatcctctgcaaatgccaacctgttcttttattattattttccgccatttttgctctctttcaagcattttttttttgcctagatccacttctctctctttgatttttaattactgcatttttgttttaatacacaataagaacaactaagagatagaatgtgacttatcaatcttttaactgagatctgtgagaatttttctatgtaccaaggaattatttacagatgggaaaaaaaggtggctggctttctattgtgaagaaagctttgagccctgaatccaagaaatctcagcaccaaactccaaagccaaagaaaaaatggttcggaaaaagcaaaaatttgagccctgtgtctgtgcctgaagaaactgaagtgataactgaagatgcaaagctaaaagaagctgaaaacgaacaaagcaaacatgcctactctgtggctcttgccaccgctgtggcggccgaggcagcggtggcagctgctcaggcggctgctgaagttgtccgtctcacttctcagccgcgccatctggggaagtcaaaggaggaaatagctgctatcaggattcaaacagcatttcgtggatatttggctaggagggcactgcgagctttgagagggttggtaaggttgaaatcgttgatcagagggcaatccgtcaaacgccaagcaactacaacgttaagatgcatgcagactctagctcgtctgcagtctgagatttctgcaaggaggattagaatgtcagaagagaaccaggctcttcagcgccagcttcaacagaaatgccagaaagagctcgagaagttgagagctcccatgagagaagactggaacgatagtacacagtcgaaggagcagatcgaagcaagacaacaaaataagcaaggagctactatgaaaagggaaagagcattggcttatgcatactgtcaccagcgatcgtggaagaactgttctagatcagtgaatcaaacatttatggatccgagtaattcacactggggttggagttggttagagcgatggatggcagcccgaccatgggaagtccaaagcacaactgataacaatgaccgtggctcagtcaagagtatgggtgcttgttcgatatctataagtgaaatcagcagagcttattctcgaagagatcttaacaatgataacaaaccatctccaacacctcagaagtcaagtcgagttcctagccgccagtctccatcgactccaccttcaaaggcaccttcgatttcatcggtttctggtaaaacaagactgccaagtccgagaggaagtcaatggggagggtatgaagactcaaggagcatactcagtacccggtctgatcgttataggagacatagcattgcagggtcctcaatgagagacgatgagagccttacaagctcacctgcagttccaagttatatggcaccaacacagtccacaaaggccaggtcccacataccaagccccttaggaagtggcacaccagataggagagtggcagggtctgcaaagaaacggcttttgttcccagcatccccagccagtagtaggagacattcagagcctcctaaagtggacataagtgaggctagaaagaatcagcatgcaccaagcaatggaaggcaagtggcttggtgaagagtgcaacaaaagttagattgaataaacatggaagggttatttcaacttgaagttcttgtagtgtggttgtgattatctttttcttcctaggttttatgattattaattataaaagggttacttttttctgggtgagatttagtttattgtttgtggttgacaaacattcttaaaaatcttcaagtttagtttcaattcatgaaatttgtaatt

SEQ ID NO: 300 - protein, 474 aa, Gossypium hirsutum
  misc_feature: Ceres CLONE ID no. 1919901
  misc_feature (109)..(129): Pfam Name: IQ Pfam Description: IQ calmodulin-binding motif
  misc_feature (1)..(500): Functional Homolog of Ceres Clone ID no. 375578 at SEQ ID NO. 252 with e-value of 1.10e-62 and BLAST sequence identity of 54.8
MGKKGGWLSIVKKALSPESKKSQHQTPKPKKKWFGKSKNLSPVSVPEETEVITEDAKLKEAENEQSKHAYSVALATAVAAEAAVAAAQAAAEVVRLTSQPRHLGKSKEEIAAIRIQTAFRGYLARRALRALRGLVRLKSLIRGQSVKRQATTTLRCMQTLARLQSEISARRIRMSEENQALQRQLQQKCQKELEKLRAPMREDWNDSTQSKEQIEARQQNKQGATMKRERALAYAYCHQRSWKNCSRSVNQTFMDPSNSHWGWSWLERWMAARPWEVQSTTDNNDRGSVKSMGACSISISEISRAYSRRDLNNDNKPSPTPQKSSRVPSRQSPSTPPSKAPSISSVSGKTRLPSPRGSQWGGYEDSRSILSTRSDRYRRHSIAGSSMRDDESLTSSPAVPSYMAPTQSTKARSHIPSPLGSGTPDRRVAGSAKKRLLFPASPASSRRHSEPPKVDISEARKNQHAPSNGRQVAW

SEQ ID NO: 301 - protein, 476 aa, Zea mays subsp. mays
  misc_feature: Ceres CLONE ID no. 228069
  misc_feature (1)..(476): Functional Homolog of Ceres Clone ID no. 375578 at SEQ ID NO. 252
MGKKGKWFGAVKKVFSPESKEKKEERLRRKSAASNPAPVDLTPSTSLEVNVSVPPPPAPPPVPRQTDEVRVPEAEQEQSKHVTLEEAPAAAAAPAQASVLPPGAPTEELAAIKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSANPMFVDPNNLQWGWSWLERWMAAKPWEGRNGTDKESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 302 - protein, 217 aa, Zea mays subsp. mays
  misc_feature: Ceres CLONE ID no. 335348
  misc_feature: Ceres Seed Line ID no. ME10681
MGKKGKWFGAVKKVFSPESKEKKEESNIDRGSVKSMSLNLGEGEITKAFNRRDSKLEKPSPPTPRPARPTSRHSPLTPSARVAPIPARRKSVTPKNGLSQVDDDARSVLSVQSERPRRHSIATSTVRDDESLTSSPSLPSYMVPTESARAKSRLQGSAMANGAETPEKGGSTGPAKKRLSFQGGTAAASPMRRHSGPPKVEIAPPQPEALVVNGGSK

SEQ ID NO: 303 - protein, 474 aa, Oryza sativa
  misc_feature: Public GI ID no. 54306075
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQATIKIQTAFRGYLARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMAPPSPMRRHSGPPKVEVVKDIAEPPQPEALVINGGSK

SEQ ID NO: 304 - protein, 193 aa, Artificial Sequence
  Fragment of Ceres CLONE ID no. 335348
ESNIDRGSVKSMSLNLGEGEITKAFNRRDSKLEKPSPPTPRPARPTSRHSPLTPSARVAPIPARRKSVTPKNGLSQVDDDARSVLSVQSERPRRHSIATSTVRDDESLTSSPSLPSYMVPTESARAKSRLQGSAMANGAETPEKGGSTGPAKKRLSFQGGTAAASPMRRHSGPPKVEIAPPQPEALVVNGGSK

SEQ ID NO: 305 - protein, 200 aa, Artificial Sequence
  Fragment of Ceres CLONE ID no. 228069
ESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 306 - protein, 189 aa, Artificial Sequence
  Fragment of Ceres CLONE ID no. 375578
DPKERAVTKNASTSAVRVPVSRAISIQRPATPNKSSRPPSRQSLSTPPSKTPSASGKARPASPRNSWLYKEDDLRSITSIRSERPRRQSTGGGSVRDDTSLTSTPPLPSYMQSTESARAKSRYRSLLLTEKLEVPERAPLAHSVVKKRLSFPVVEKPSVVPTEKPRERVRRHSDPPKVDPATLKDAPAA

SEQ ID NO: 307 - protein, 193 aa, Artificial Sequence; identical to SEQ ID NO: 304
  Fragment of Ceres CLONE ID no. 229668

SEQ ID NO: 308 - protein, 199 aa, Artificial Sequence
  Fragment of Public GI ID no. 54306075
ESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMAPPSPMRRHSGPPKVEVVKDIAEPPQPEALVINGGSK

SEQ ID NO: 309 - protein, 188 aa, Artificial Sequence
  Fragment of Public GI ID no. 56202321
DPKDHYSTKNPSTSASRTYVPRAISIQRPATPNKSSRPPSRQSPSTPPSRVPSVTGKIRPASPRDSWLYKEDDLRSITSIRSERPRRQSTGGASVRDDASLTSTPALPSYMQSTESARAKSRYRSLLTDRFEVPERVPLVHSSIKKRLSFPVADKPNGEHADKLMERGRRHSDPPKVDPASLKDVPVS

SEQ ID NO: 310 - protein, 199 aa, Artificial Sequence
  Fragment of Ceres CLONE ID. 1792902
ESNVDRGSVKSMSLNLGEGEITKAFNRRDSKPEKPSPPTPKLTRPASRQSPSTPSAKVAPIPVRRKSVTPKNGLSHVDDDARSVFSVQSERPRRHSIATSTVRDDESLASSPSLPSYMVPTESARAKSRLQGSALNNGAETPEKGSSAGPVKKRLSFQGGTAAASPMRRHSGPPKVGSAVKDIVAPPQPEALVINGGSK

SEQ ID NO: 311 - protein, 200 aa, Artificial Sequence
  Fragment of Ceres CLONE ID no. 1727738
KESNIDRGSVKSMSLNLGEGEITKAFNRRDSKPEKPSPPTPKLTRPASRQSPSTPSAKVAPIPARRKSATPENGLSHVDDDARSVFSVQSERPRRHSIATSTVQDNESLASSPSLPSYMVPTESARAKSRLQGSALTNGAETPEKGSSAGPVKKRLSFQGGTAAASPMRRHSGPPKVDSAVKDIVAPPQPEALVINGGSK

SEQ ID NO: 312 - protein, 471 aa, Panicum virgatum
  misc_feature: Ceres CLONE ID no. 1727738
  misc_feature (1)..(471): Functional Homolog of Ceres Clone ID no. 375578 at SEQ ID NO. 252
MGKKGKWFGAVKKVFSPESKEKKEERQRRKSAASNPTPRDLTPSTSLEVNVSVPPPPAPPALHQIEEIRAPEAEQEQSKHVTVEEAPAAPAQASVLPPGVPSEELAAIKIQTAFRGYLARRALRALRGLVRLKSLVEGDSVRRQSASTLRCMQTLSRVQSQIRSRRAKMSEENQALQRQLLLKQELENFRMGENWDDSTQSKEQIEASLISRQEAAIRRERALAYAFSHQWKSTSRSVNPMFVDPNNLQWGWSWLERWMAAKPWEGCNGADKESNIDRGSVKSMSLNLGEGEITKAFNRRDSKPEKPSPPTPKLTRPASRQSPSTPSAKVAPIPARRKSATPENGLSHVDDDARSVFSVQSERPRRHSIATSTVQDNESLASSPSLPSYMVPTESARAKSRLQGSALTNGAETPEKGSSAGPVKKRLSFQGGTAAASPMRRHSGPPKVDSAVKDIVAPPQPEALVINGGSK

SEQ ID NO: 313 - DNA, 1806 bp, Zea mays subsp. mays
  misc_feature: Ceres CLONE ID no. 228069
  misc_feature: Encodes the peptide sequence at SEQ ID NO 301
gagccgcggaggagcagcggcgcatcgcaacactaaccaaagtcctcctctccaggtgccgagccagggtgactgttccgaggagcgtggcgtggacccatggggaagaagggcaagtggttcggtgccgtcaagaaggtcttcagccccgaatccaaggagaagaaagaggagaggctaaggaggaaatcagcagctagcaacccagcaccggtagatctgaccccatctacctccctggaagtcaatgtttcggtgccaccccctccggctcctcctccagttcctcgccagaccgacgaggtcagggtccccgaagccgagcaggagcagagcaagcatgtcaccctggaggaggcccctgctgctgctgctgccccagcacaggcgtcggtgctgccacctggtgcgccaaccgaagagctcgccgcaatcaagatccagaccgccttccgaggttacctggcaaggagggcactaagagcactacgaggccttgtacgattgaagtcattggttgagggtaattcagttaagcgtcaatctgcaagcactctgcgctgtatgcaaactctatcgcgggtgcagtcacaaatacgatctaggagagcaaagatgtccgaggagaaccaggccctccaacgccagctcctacttaaacaggaactggagaatttcagaatgggtgagaactgggacgacagcactcaatccaaggagcaaatcgaggcaagcctaataagcaggcaagaggcagcgataagaagagaaagagctcttgcatatgcattttcacatcagtggaagagcacatcaagatctgcgaacccaatgtttgtagacccaaataacttgcagtggggctggagctggttggagcgctggatggcagcaaaaccttgggagggacgcaatgggaccgacaaggagagcaacattgatcgcggctccgtcaagaatatgagcttgaaccttggagttggagagggtgagatcacaaaagctttcaaccgccgggactcaaagccagagaagccatcaccaccgactccaaaaccggcccgtccagcttccaggcaatccccttcgacgccctctgctagagtggccccaatacctgcgaggaggaaatccagcacgccaaagaatgggctttcacaggtggacgatgacgtgaggagcgtgctcagtgtgcagtctgagcgaccaaggaggcacagcatagccacgacgtcgaccatgcgggacgatgagagcctcgcgagctccccgtcgctcccgagctacatggttcccacagaatctgcgagggccaaatctcgcacagcaacggccaatggcgcagagacgcctgagaaaggaggctctgctggaccagtcaagaagaggttgtctttccaaggtggagctgcggctgcctcaccgatgcgacggcattctggccctcccaaggtggagagcgctgtgaaggacattgctgcgccaccacagcctgaggccttggtagccaatggtggtggaagcaagtgacttgtattgacaagttccaggatgggggagcgggttatggtcttatggagggacatgtttcatccgtgaacagaagttaagagtggtgccggatctacgaatggtttgaattgttttcccgttacaaccacattgtttgctgtataagattcactgtacctgccagttggttccatttgttgttttctgtaaaacaaacatcaatttgtcactagaatctgtgatgcttgtatgtaaacaggtcctctatttatgtgagccatatatttcattttc

SEQ ID NO: 314 - DNA, 1083 bp, Zea mays subsp. mays
  misc_feature: Ceres CLONE ID no. 335348
  misc_feature: Encodes the peptide sequence at SEQ ID NO 302
aacccccgccgtatcggtcttgttcgttgtcctgccagatacagataggtggctaccactggctcgcgtgacctgttggcttgcttgctcctctccaggttcaggcaggggagagtgcctgtttcgagggggcgtggagcggagccggagccatggggaagaagggcaagtggttcggcgccgtcaagaaggtcttcagccctgaatccaaggagaagaaagaggagagcaacattgaccggggatccgttaagagcatgagcttgaaccttggagagggtgagatcacaaaagctttcaaccgccgggactcaaagctagaaaagccatcgccgccaactccaagaccggcccgtccaacttccaggcattcccctttgacgccctctgctagagtggcaccgatacctgcgaggagaaaatctgtcacgcccaagaacgggctttcacaggtggacgatgacgcgaggagcgtgctcagtgtgcagtctgagcggccaaggaggcacagtatagccacctcgactgtgcgggacgacgagagcctcacgagctccccgtcgctcccaagctacatggttcccacagaatctgcaagggccaaatctcgcctccagggttcagcaatggccaatggcgcagagacacctgagaaaggaggctcaactggaccagccaagaagaggttatccttccagggtggaactgcggctgcctcgccaatgcgacgacattctggtcctcccaaggtggagatcgcgccaccacaaccagaggccttggtagtcaatggtggaagcaagtgacacatatgtgatgagtaccaggatgagaaacggattatgaagatattagtttcattttcatccatgaatagaagttaaaagtggtatcatatctatgaatggtttcaattgtttttctgttacaaccacattatttgctatatacgattcacagtacctgccagttgattccattggttgtttctgtaaaacaaatatcaatttgtcactagaatctgtgatgtttgtatgtaaacagatcctctatttatgtgagacatatatttcttttctttcg

SEQ ID NO: 315 - DNA, 2024 bp, Panicum virgatum
  misc_feature: Ceres CLONE ID no. 1727738
  misc_feature: Encodes the peptide sequence at SEQ ID NO 312
gttctctctccctcgtcactctcgccactgctcccagctgttgcgacctccgatcatccaaggctcctgcacccctgtcagtcctagctccagccaaaaatcgttggcttccgctgcctgctcctccgccttgcacctcccatgaccttccacgcgacatgattgcattgcaggcccctgcggagctcagtgtcctcccacgccgctgacgccttcttgttgcctccccgctgctgcgcacaaccgaaagggccttcctctcttcctttgcttccgcggaaagatttggcgatttgttcatctactaaagttgcatctctcttggtgattgtttcgaggagtgtggagtggagccatggggaagaagggcaagtggttcggcgcggtcaagaaagtgttcagccctgaatccaaggagaagaaggaggagaggcagaggaggaaatcagcagctagcaaccctactccacgagatctgaccccgtcgacctccttggaagtcaatgtttcggtgccaccccctccagctcctccggcccttcaccagattgaggaaatcagggcccctgaagctgagcaggagcagagcaagcacgtcaccgtagaggaggctcctgctgcccctgcacaggcgtcggtgctgccacctggtgtgccaagtgaagagcttgctgcaatcaagattcagactgccttccgaggttacctggcaaggagggcactgcgagcgctgcggggccttgttcgattgaaatcattggttgagggtgattcagttaggcgtcaatctgcaagcactcttcgctgtatgcagactctatcgcgggtgcagtcacaaatacgttctaggagagcaaagatgtctgaggagaaccaggcccttcagcgccagctcctactgaagcaggaactggagaatttcaggatgggtgagaactgggatgacagcactcaatccaaagagcaaatcgaggcaagcctaataagcaggcaagaggcagcgattagaagagaaagagcgcttgcatatgcattttcacatcagtggaagagcacttcgagatctgtcaacccaatgtttgtagacccaaacaacttgcagtggggctggagctggttggagcgctggatggctgcaaaaccttgggagggctgcaatggggctgataaggagagcaacattgaccgtggatctgttaagagcatgagcttgaaccttggagagggtgagatcacaaaagctttcaaccgccgggactcaaagccagaaaagccatcaccgccaactccaaaactaacccgtccagcctccaggcaatccccttcgacgccctctgctaaagtagcgccaatacctgctaggagaaaatccgccacgccagagaatgggctttcacatgtggatgacgatgcgagaagtgtgttcagcgtgcagtctgagcgaccaaggaggcacagtatagccacctcgactgtgcaggacaatgagagtctcgcaagctccccatcactcccaagttacatggttcccacagaatctgcaagggcgaagtctcgtctccagggatcagcattgactaatggtgcagagacaccagagaaaggaagctctgctggaccggtcaagaaaaggttgtcatttcaaggtggaacagcggctgcctcaccaatgcgacggcattctggtcctcccaaggtggacagtgcggtgaaggatattgttgccccaccacagccagaggccttggtgatcaatggtggaagcaagtgactcataccaggaggggaaagcggattatgaatatatattttatcgatgaagaaaggttaacgtgatatcagctcaatgagtgatttgaattgttttcttacgaccacattgtttgctctataagattcgcagtacctgccagttgattccattcgttgtttctgtaaaacaagtatcggttcgtcactagaatcaatgaagtttgtatgtaaacaggtcttctatttatgtgagccatatatttcttcttctg

What is claimed is:

1. A method of increasing tolerance to salinity in a plant, said method comprising
   (I) transforming a plant cell with a first nucleotide sequence that is a regulatory region operably linked to at least one second isolated nucleic acid comprising a nucleotide sequence selected from the group consisting of:
      (a) a nucleotide sequence encoding SEQ ID NO: 146;
      (b) the nucleotide sequence according to SEQ ID NO: 145; and
      (c) a nucleotide sequence hybridizing to the full length complementary sequence of the nucleotide sequence as set forth in SEQ ID NO: 145 under high stringency conditions which comprise
         (i) hybridization at 42° C. in 50% formamide, 6×SSC or 6×SSPE, 0.05% Blotto or 5× Denhardt's Reagent, 100 µg/ml denatured salmon sperm DNA, 0.05% SDS and washings at 65° C. first in 2×SSC, 0.1% SDS for at least 30 min to one hour and subsequently in 0.1× SSC, 0.5% SDS for at least 30 min to one hour; or
         (ii) hybridization at 65° C. in 6×SSC or 6×SSPE, 0.05% Blotto or 5× Denhardt's Reagent, 100 µg/ml denatured salmon sperm DNA, 0.05% SDS and washings at 65° C. first in 2×SSC, 0.1% SDS for at least 30 min to one hour, and subsequently in 0.1×SSC, 0.5% SDS for at least 30 min to one hour;
   wherein said hybridizing nucleotide sequence encodes a calcium binding protein having a PsbP domain;
   (II) expressing said second isolated nucleic acid;
   (III) generating from said plant cell a transformed plant in which said at least one second isolated nucleic acid is overexpressed; and
   (IV) selecting from a plurality of said transformed plants a plant exhibiting increased tolerance to salinity as compared to a control plant.

2. The method of claim 1, wherein said regulatory region is a promoter selected from the group consisting of YP0092 (SEQ ID NO: 38), PT0676 (SEQ ID NO: 12), PT0708 (SEQ ID NO: 17), PT0613 (SEQ ID NO: 5), PT0672 (SEQ ID NO: 11), PT0678 (SEQ ID NO: 13), PT0688 (SEQ ID NO: 15), PT0837 (SEQ ID NO: 24), a napin promoter, an Arcelin-5 promoter, a phaseolin gene promoter, a soybean trypsin inhibitor promoter, a ACP promoter, a stearoyl-ACP desaturase gene promoter, a soybean α' subunit of β-conglycinin promoter, an oleosin promoter, a 15 kD zein promoter, a 16 kD zein promoter, a 19 kD zein promoter, a 22 kD zein promoter, a 27 kD zein promoter, an Osgt-1 promoter, a beta-amylase gene promoter, and a barley hordein gene promoter.

3. The method of claim 1, wherein said regulatory region is a promoter selected from the group consisting of p326 (SEQ ID NO: 76), YP0144 (SEQ ID NO: 55), YP0190 (SEQ ID NO: 59), p13879 (SEQ ID NO: 75), YP0050 (SEQ ID NO: 35), p32449 (SEQ ID NO: 77), 21876 (SEQ ID NO: 1), YP0158 (SEQ ID NO: 57), YP0214 (SEQ ID NO: 61), YP0380 (SEQ ID NO: 70), PT0848 (SEQ ID NO: 26), and PT0633 (SEQ ID NO:7), a cauliflower mosaic virus (CaMV) 35S promoter, a mannopine synthase (MAS) promoter, a 1' or 2' promoter derived from T-DNA of *Agrobacterium tumefaciens*, a figwort mosaic virus 34S promoter, an actin promoter, and an ubiquitin promoter.

4. The method of claim 1, wherein said regulatory region is a promoter selected from the group consisting of a ribulose-1,5-bisphosphate carboxylase (RbcS) promoter, a pine cab6 promoter, a Cab-1 gene promoter from wheat, a CAB-1 promoter from spinach, a cab1R promoter from rice, a pyruvate orthophosphate dikinase (PPDK) promoter from corn, a tobacco Lhcb1*2 promoter, an *Arabidopsis thaliana* SUC2 sucrose-H+ symporter promoter, a thylakoid membrane protein promoter from spinach, PT0535 (SEQ ID NO: 3), PT0668 (SEQ ID NO: 2), PT0886 (SEQ ID NO: 29), PR0924 (SEQ ID NO: 265), YP0144 (SEQ ID NO: 55), YP0380 (SEQ ID NO: 70) and PT0585 (SEQ ID NO: 4).

5. The method according to claim 1, wherein said second isolated nucleic acid comprises a nucleotide sequence encoding SEQ ID NO:146.

6. The method according to claim 1, wherein said second isolated nucleic acid comprises the nucleotide sequence as set forth in SEQ ID NO:145.

* * * * *